United States Patent 10,293,058 (RNA CONTAINING COMPOSITION FOR TREATMENT OF TUMOR DISEASES) - sequence listing, part 4

SEQ ID NO: 9063 - RNA, 3189 nt, Artificial Sequence
  derived and/or modified sequence opt2 from NALP2__Homo_sapiens__AAG30289
auggucuccuccgcccagaugggcuucaaccuccaggcccuccucgagcagcucucccaggacgagcucuccaaguucaaguaccucaucaccaccuucucccucgcccacgagcuccagaagaucccccacaaggaggucgacaaggccgacggcaagcagcucgucgagauccucaccacccacugcgacuccuacugggucgagauggccucccuccaggucuucgagaagaugcaccgcauggaccucuccgagcgcgccaaggacgagguccgcgaggccgcccucaaguccuucaacaagcgcaagccccucucccucggcaucacccgcaaggagcgccccccccucgacgucgacgagaugcucgagcgcuucaagaccgaggcccaggccuucaccgagaccaagggcaacgucaucugccucggcaaggaggucuucaagggcaagaagcccgacaaggacaaccgcugccgcuacauccucaagaccaaguuccgcgagauguggaaguccuggcccggcgacuccaaggagguccaggucauggccgagcgcuacaagaugcucauccccuucuccaacccccgcguccuccccggccccuucuccuacaccgucguccucuacggccccgccggccucggcaagaccacccucgcccagaagcucaugcucgacugggccgaggacaaccucauccacaaguucaaguacgccuucuaccucuccugccgcgagcucucccgccucggccccugcuccuucgccgagcucgucuuccgcgacuggcccgagcuccaggacgacaucccccacauccucgcccaggcccgcaagauccucuucgucaucgacggcuucgacgagcucggcgccgcccccggcgcccucaucgaggacaucugcggcgacugggagaagaagaagcccguccccguccuccucggcucccuccucaaccgcgucaugcuccccaaggccgcccuccucgucaccacccgcccccgcgcccuccgcgaccuccgcauccucgccgaggagcccaucuacauccgcgucgagggcuuccucgaggaggaccgccgcgccuacuuccuccgccacuucggcgacgaggaccaggccaugcgcgccuucgagcucaugcgcuccaacgccgcccucuuccagcucggcuccgcccccgccgucugcuggaucgucugcaccacccucaagcuccagauggagaagggcgaggaccccguccccaccugccucacccgcaccggccucuuccuccgcuuccucugcucccgcuucccccagggcgcccagcuccgcggcgcccuccgcacccucucccuccucgccgcccagggccucugggcccagaccuccguccuccaccgcgaggaccucgagcgccucggcguccaggaguccgaccuccgccucuuccucgacggcgacauccuccgccaggaccgcgucuccaagggcugcuacuccuucauccaccucuccuuccagcaguuccucaccgcccucuucuacacccucgagaaggaggaggaggaggaccgcgacggccacaccugggacaucggcgacguccagaagcuccucuccggcgucgagcgccuccgcaaccccgaccucauccaggccggcuacuacuccuucggccucgccaacgagaagcgcgccaaggagcucgaggccaccuucggcugccgcaugucccccgacaucaagcaggagcuccuccgcugcgacaucuccugcaagggcggccacuccaccgucaccgaccuccaggagcuccucggcugccucuacgagucccaggaggaggagcucgucaaggaggucauggcccaguucaaggagaucucccuccaccucaacgccgucgacgucguccccuccuccuucugcgucaagcacugccgcaaccuccagaagaugucccuccaggucaucaaggagaaccuccccgagaacgucaccgccuccgaguccgacgccgaggucgagcgcucccaggacgaccagcacaugcuccccuucuggaccgaccucugcuccaucuucggcuccaacaaggaccucaugggccucgccaucaacgacuccuuccucuccgccucccucguccgcauccucugcgagcagaucgccuccgacaccugccaccuccagcgcgucgucuucaagaacaucucccccgccgacgcccaccgcaaccucugccucgcccuccgcggccacaagaccgucaccuaccucacccuccagggcaacgaccaggacgacauguuccccgcccucugcgagguccuccgccaccccgagugcaaccuccgcuaccucggccucgucuccugcuccgccaccacccagcagugggccgaccucucccucgcccucgaggucaaccagucccucaccugcgucaaccucuccgacaacgagcuccucgacgagggcgccaagcuccucuacaccacccuccgccaccccaagugcuuccuccagcgccucucccucgagaacugccaccucaccgaggccaacugcaaggaccucgccgccguccucgucgucucccgcgagcucacccaccucugccucgccaagaaccccaucggcaacaccggcgucaaguuccucugcgagggccuccgcuaccccgagugcaagcuccagacccucguccucuggaacugcgacaucaccuccgacggcugcugcgaccucaccaagcuccuccaggagaaguccucccuccucugccucgaccucggccucaaccacaucggcgucaagggcaugaaguuccucugcgaggcccuccgcaagccccucugcaaccuccgcugccucuggcucuggggcugcuccaucccccccuucuccugcgaggaccucugcuccgcccucuccugcaaccagucccucgucacccucgaccucggccagaacccccucggcuccuccggcgucaagaugcucuucgagacccucaccugcuccuccggcacccuccgcacccuccgccucaagaucgacgacuucaacgacgagcucaacaagcuccucgaggagaucgaggagaagaacccccagcucaucaucgacaccgagaagcaccaccccugggccgagcgccccuccucccacgacuucaugaucuga

SEQ ID NO: 9064 - RNA, 3189 nt, Artificial Sequence
  derived and/or modified sequence opt3 from NALP2__Homo_sapiens__AAG30289
auggugagcuccgcccagaugggcuucaaccugcaagcucuccuugagcagcugucucaggacgaauugucaaaguuuaaauacuuaaucaccacauucagucuggcacacgagcuacagaagauuccccauaaagaagucgauaaggccgacgggaaacaacucguugagauacugacuacgcacugcgauagcuauuggguggaaauggcgucccuucagguauuugagaagaugcauagaauggaccugucugagagggcuaaggaugaagugcgggaggccgcauugaaaucguucaauaagcgcaaaccucucucacugggaaucacccgaaaggaacguccaccgcuggacgucgaugagaugcucgagagauuuaaaacagaagcccaggcuuucacugagaccaaggguaacgugauuuguuuaggcaaggaaguuuuuaaagggaagaaacccgacaaggauaauaggugccgguacauccugaaaacaaaguuccgcgagauguggaaaagcuggccuggagacaguaaggaagugcaggucauggcagagagauauaagaugcuuauuccauuuuccaaccccaggguguugccuggcccauucucuuacaccguaguucuguauggucccgccgggcuaggaaaaacuacacucgcucaaaagcugaugcuugauugggccgaggacaaucugauccacaaauuuaaguacgcguucuauuugagcugucgggaacucucccgccugggcccuugcucauuugcagaguuaguguuccgagauuggccagaacugcaggacgacauaccgcauauccucgcccaggcuagaaaaauucuuuucgucaucgauggcuuugacgagcugggggccgcacccggagcuuugauugaagauaucuguggugacugggagaagaagaaaccugugccagugcuacugggcagucuccugaacagggucaugcuucccaaggccgcgcuguugguuaccacgcggccucgugcccuccgcgaucugagaauauuagcagaggaaccaauuuacaucaggguggagggguuccuggaagaggaccggcgagcuuacuuucuacgccacuucggagaugaagaccaggccaugagagcuuuugagcucaugaggagcaaugccgcacuguuccaacuuggcucugcccccgcuguaugcuggauuguguguacuaccuugaaacugcagauggagaagggugaagauccggucccuacaugccucacucggaccgggcuguuucuucgcuuccuguguuccagauuuccccagggagcgcaauugaggggcgcacuccguacacugucauuacuggccgcucagggccuaugggcccagaccagcgugcuccaccgggaggaccuggaacgacuugggguucaggagagugauuugagacuguuccucgacggagacauccugaggcaagaucgcgugucuaaagguugcuauuccuuuauccaucugagcuuccagcaguuuuuaacggcacuuuucuacacuuuggagaaggaagaggaagaggaccgggauggccacacaugggacauuggggauguccagaagcuccugucgggaguggaaagacuaaggaacccagaccugauacaagccggcuauuacucuuucggucucgcuaaugagaaacgcgccaaggagcuggaagcaaccuuugggugucgaauguccccugauaucaaacaggagcuuuugcggugcgacauuucaugcaagggcggacauaguacuguaacagaucugcaggaauuacucggcugucuguaugagagccaggaagaggagcuuguuaaagaagugauggcgcaauucaaggagaucucccugcacuugaacgcugucgacgugguccccucuagcuuuugcgugaagcacugucguaaucuccagaaaaugucacugcagguuauaaaggaaaaccuaccagagaaugugaccgccagugaauccgaugcagagguagagagaagccaggacgaucaacauaugcugcccuucuggacggaccucugcucuauuuuugggucaaacaaagaccugaugggacuugccaucaaugauaguuucuugagcgcuucccuggucaggaucuuaugugaacagauugccucugauaccugccaccuccagcgcgugguuuuuaagaacaucucgccugcagacgcucaucggaaccugugucuugcccugagaggucacaaaacagugacuuaccuaacccuccaaggcaaugaccaggaugacauguucccagcgcugugcgaggucuugaggcauccggaauguaaccugcgauauuuagggcucgugagcugcuccgccacaacucagcagugggcugaucugucacuugcacuggagguaaaucaaaguuugaccugugugaaccucucugacaaugagcugcuagaugaaggagccaagcugcuuuacacaacccuccgccaccccaaaugcuuucugcagcgguugagccuggagaacugccacuuaacugaagcuaauuguaaggaccucgccgcaguucuggucguguccagagagcuuacgcaucugugcuuggcgaagaacccuauuggcaauacaggugugaaauuccucugugaagggcugagguacccagagugcaagcuacagacccugguccuuuggaacugugauauaacuucagacggcugcugugaucucaccaaacuguugcaggaaaagagcucuuuacugugccucgaccugggacuuaaucacaucggcguuaaagggaugaaguuucugugugaggccuugcguaagccccuaugcaaccugcgcugucucuggcuguggggaugcuccauuccuccauucaguugcgaggaccuuuguagcgcuuuaucuugcaaucaaucccuggugacacucgauuugggucagaacccccugggcucaaguggggugaaaaugcucuuugaaacccugacuuguagcucgggaacacuucggacgcugagauugaagaucgacgauuucaaugacgagcuaaacaaacugcucgaagagaucgaggaaaagaacccgcaguuaauuauagauaccgagaaacaucacccuugggccgaaaggccauccucucacgacuucaugaucuga

SEQ ID NO: 9065 - RNA, 3189 nt, Artificial Sequence
  derived and/or modified sequence opt4 from NALP2__Homo_sapiens__AAG30289
auggugagcagcgcccagaugggcuucaaccugcaggcccugcuggagcagcugagccaggacgagcugagcaaguucaaguaccugaucaccaccuucagccuggcccacgagcugcagaagaucccccacaaggagguggacaaggccgacggcaagcagcugguggagauccugaccacccacugcgacagcuacuggguggagauggccagccugcagguguucgagaagaugcacagaauggaccugagcgagagagccaaggacgaggugagagaggccgcccugaagagcuucaacaagagaaagccccugagccugggcaucaccagaaaggagagacccccccuggacguggacgagaugcuggagagauucaagaccgaggcccaggccuucaccgagaccaagggcaacgugaucugccugggcaaggagguguucaagggcaagaagcccgacaaggacaacagaugcagauacauccugaagaccaaguucagagagauguggaagagcuggcccggcgacagcaaggaggugcaggugauggccgagagauacaagaugcugauccccuucagcaaccccagagugcugcccggccccuucagcuacaccguggugcuguacggccccgccggccugggcaagaccacccuggcccagaagcugaugcuggacugggccgaggacaaccugauccacaaguucaaguacgccuucuaccugagcugcagagagcugagcagacugggccccugcagcuucgccgagcugguguucagagacuggcccgagcugcaggacgacaucccccacauccuggcccaggccagaaagauccuguucgugaucgacggcuucgacgagcugggcgccgcccccggcgcccugaucgaggacaucugcggcgacugggagaagaagaagcccgugcccgugcugcugggcagccugcugaacagagugaugcugcccaaggccgcccugcuggugaccaccagacccagagcccugagagaccugagaauccuggccgaggagcccaucuacaucagaguggagggcuuccuggaggaggacagaagagccuacuuccugagacacuucggcgacgaggaccaggccaugagagccuucgagcugaugagaagcaacgccgcccuguuccagcugggcagcgcccccgccgugugcuggaucgugugcaccacccugaagcugcagauggagaagggcgaggaccccgugcccaccugccugaccagaaccggccuguuccugagauuccugugcagcagauucccccagggcgcccagcugagaggcgcccugagaacccugagccugcuggccgcccagggccugugggcccagaccagcgugcugcacagagaggaccuggagagacugggcgugcaggagagcgaccugagacuguuccuggacggcgacauccugagacaggacagagugagcaagggcugcuacagcuucauccaccugagcuuccagcaguuccugaccgcccuguucuacacccuggagaaggaggaggaggaggacagagacggccacaccugggacaucggcgacgugcagaagcugcugagcggcguggagagacugagaaaccccgaccugauccaggccggcuacuacagcuucggccuggccaacgagaagagagccaaggagcuggaggccaccuucggcugcagaaugagccccgacaucaagcaggagcugcugagaugcgacaucagcugcaagggcggccacagcaccgugaccgaccugcaggagcugcugggcugccuguacgagagccaggaggaggagcuggugaaggaggugauggcccaguucaaggagaucagccugcaccugaacgccguggacguggugcccagcagcuucugcgugaagcacugcagaaaccugcagaagaugagccugcaggugaucaaggagaaccugcccgagaacgugaccgccagcgagagcgacgccgagguggagagaagccaggacgaccagcacaugcugcccuucuggaccgaccugugcagcaucuucggcagcaacaaggaccugaugggccuggccaucaacgacagcuuccugagcgccagccuggugagaauccugugcgagcagaucgccagcgacaccugccaccugcagagagugguguucaagaacaucagccccgccgacgcccacagaaaccugugccuggcccugagaggccacaagaccgugaccuaccugacccugcagggcaacgaccaggacgacauguuccccgcccugugcgaggugcugagacaccccgagugcaaccugagauaccugggccuggugagcugcagcgccaccacccagcagugggccgaccugagccuggcccuggaggugaaccagagccugaccugcgugaaccugagcgacaacgagcugcuggacgagggcgccaagcugcuguacaccacccugagacaccccaagugcuuccugcagagacugagccuggagaacugccaccugaccgaggccaacugcaaggaccuggccgccgugcugguggugagcagagagcugacccaccugugccuggccaagaaccccaucggcaacaccggcgugaaguuccugugcgagggccugagauaccccgagugcaagcugcagacccuggugcuguggaacugcgacaucaccagcgacggcugcugcgaccugaccaagcugcugcaggagaagagcagccugcugugccuggaccugggccugaaccacaucggcgugaagggcaugaaguuccugugcgaggcccugagaaagccccugugcaaccugagaugccuguggcuguggggcugcagcaucccccccuucagcugcgaggaccugugcagcgcccugagcugcaaccagagccuggugacccuggaccugggccagaacccccugggcagcagcggcgugaagaugcuguucgagacccugaccugcagcagcggcacccugagaacccugagacugaagaucgacgacuucaacgacgagcugaacaagcugcuggaggagaucgaggagaagaacccccagcugaucaucgacaccgagaagcaccaccccugggccgagagacccagcagccacgacuucaugaucuga

SEQ ID NO: 9066 - RNA, 3189 nt, Artificial Sequence
  derived and/or modified sequence opt5 from NALP2__Homo_sapiens__AAG30289
auggugagcuccgcccagaugggcuucaaccugcaagcucuccuggagcagcuuucucaggacgaacugagcaaguuuaaauaccucaucaccacauucucccuggcccacgagcuucagaagauuccccauaaagaagucgauaaggcggacgggaaacaacugguugagauccucacgacccacugcgauucuuauuggguggaaauggcuagccuucagguguuugagaagaugcauagaauggaccuguccgagcgggccaaggaugaaguccgcgaggccgcucucaaaucuuucaauaagagaaaaccucugagccuuggaauuacacggaaggaacgcccgccccuggacguggaugagaugcucgagagauuuaaaaccgaagcccaggcuuucacagagaccaagggcaacguuaucugucuggggaaggaaguguuuaaaggaaagaaaccugacaaggauaaucggugccgcuacauucuuaaaacaaaguucagagagauguggaaauccuggcccggcgacagcaaggaaguccaggugauggccgagcgguauaagaugcugaucccuuuuucuaacccccgcguucucccugggccguucuccuacaccgugguccuguauggacccgcgggccugggcaaaacgacccucgcccaaaagcugaugcuugauugggcugaggacaaucugauccacaaauuuaaguacgccuucuaucucagcuguagagaacugucucggcuugggccuugcuccuuugcugagcugguguuccgcgauuggcccgaacuccaggacgacauuccucauauccuggcccaggcgagaaaaauucuguucgugaucgauggauuugacgagcucggcgccgcucccggggcccugauugaagauaucuguggagacugggagaagaagaaaccggucccuguucuucugggcagccuccugaaccgggugaugcuucccaaggcugcccugcucgugacaacccgcccuagagcccugcgggaucugcggauucucgcugaggaacccaucuacauccgcgucgagggguuccuggaagaggaccggagagcguacuuucuucgccacuucggagaugaagaccaggccaugcgggcuuuugagcugaugagaucuaaugccgcccucuuccaacugggcuccgcucccgccgugugcuggauuguuuguacaacccugaaacuucagauggagaagggcgaagauccugugccgacgugccucacacgcaccgggcuguuucugcgguuccucuguagcagauuuccccagggagcgcaacugcgcggcgcucuuagaacacugucccuccuggccgcccaggggcugugggcucagaccucuguccuucacagagaggaccucgaacgccugggagugcaggagagcgaucugagacucuuccuggacggcgacauccuuagacaagaucggguuuccaaagggugcuauagcuuuauucaucugucuuuccagcaguuucucaccgcccuguucuacacacuggagaaggaagaggaagaggaccgcgauggacacacgugggacaucggcgaugugcagaagcugcucuccggcgucgaaagacugcggaacccugaccugauucaagcuggguauuacagcuucggacucgccaaugagaaaagagcgaaggagcuggaagccaccuuuggcugucgcaugucucccgauaucaaacaggagcuucugcggugcgacaucagcugcaaagggggacauuccacagugaccgaucuccaggaacugcugggcugucuuuaugagucucaggaagaggagcucgucaaggaagugauggcucaauucaaggagauuagccugcaccugaacgccguugacguggucccuuccagcuuuugcgugaagcacuguagaaaucuccagaaaaugucucugcagguuaucaaggaaaaccuucccgagaaugugacagcuuccgaaagcgaugccgaggucgagcgcucucaggacgaucaacauaugcugccguucuggaccgaccucugcuccauuuuugggagcaacaaagaccugaugggccuggcgaucaaugauuccuuccuuucugccagccuggugcggauucucugugaacagaucgcuuccgacacgugccaucugcagcgggugguuuuuaagaacaucucuccugccgaugcucaccgcaaccucugucuggcccuuagaggacacaaaacagucaccuaccugacccuccaaggcaaugaccaggaugacauguuccccgcccugugcgaggugcugcggcauccugaauguaaccuucgcuaucuggggcucgugagcugcuccgcuacaacccagcagugggcggaucugagccucgcccuggaggucaaucaaucucuuacaugugugaaccuguccgacaaugagcuccuggaugaaggagcuaagcugcuuuacacgacccugagacaccccaaaugcuuucuccagcggcugagccucgagaacugccaccugacagaagccaauuguaaggaccuugccgcuguucugguggucucucgcgagcugacccaucucugccuggccaagaacccuauuggcaauacaggggugaaauuccuuugugaaggacugagauaccccgagugcaagcuccagacccugguucucuggaacugugauaucacguccgacggcugcugugaucugaccaaacuucugcaggaaaagagcucucugcucugccuggaccuugggcugaaucacauuggcgugaaaggaaugaaguuucucugugaggcgcugcggaagccgcucugcaaccugcgcugucuuuggcuguggggcugcagcaucccucccuucuccugcgaggaccuguguagcgcucucucuugcaaucaaucccuggucacacuugaucuggggcagaacccccucggaagcuccggcgugaaaaugcuguuugaaacccucacauguucuagcgggacccugagaacgcuucggcugaagauugacgauuucaaugacgagcugaacaaacuccuggaagagaucgaggaaaagaacccucagcuuauuaucgauacagagaaacaucacccgugggccgaaagacccuccucucacgacuucaugaucuga

SEQ ID NO: 9067 - protein, 1036 aa, Artificial Sequence
  NALP3__Homo_sapiens__Q96P20
MKMASTRCKLARYLEDLEDVDLKKFKMHLEDYPPQKGCIPLPRGQTEKADHVDLATLMIDFNGEEKAWAMAVWIFAAINRRDLYEKAKRDEPKWGSDNARVSNPTVICQEDSIEEEWMGLLEYLSRISICKMKKDYRKKYRKYVRSRFQCIEDRNARLGESVSLNKRYTRLRLIKEHRSQQEREQELLAIGKTKTCESPVSPIKMELLFDPDDEHSEPVHTVVFQGAAGIGKTILARKMMLDWASGTLYQDRFDYLFYIHCREVSLVTQRSLGDLIMSCCPDPNPPIHKIVRKPSRILFLMDGFDELQGAFDEHIGPLCTDWQKAERGDILLSSLIRKKLLPEASLLITTRPVALEKLQHLLDHPRHVEILGFSEAKRKEYFFKYFSDEAQARAAFSLIQENEVLFTMCFIPLVCWIVCTGLKQQMESGKSLAQTSKTTTAVYVFFLSSLLQPRGGSQEHGLCAHLWGLCSLAADGIWNQKILFEESDLRNHGLQKADVSAFLRMNLFQKEVDCEKFYSFIHMTFQEFFAAMYYLLEEEKEGRTNVPGSRLKLPSRDVTVLLENYGKFEKGYLIFVVRFLFGLVNQERTSYLEKKLSCKISQQIRLELLKWIEVKAKAKKLQIQPSQLELFYCLYEMQEEDFVQRAMDYFPKIEINLSTRMDHMVSSFCIENCHRVESLSLGFLHNMPKEEEEEEKEGRHLDMVQCVLPSSSHAACSHGLVNSHLTSSFCRGLFSVLSTSQSLTELDLSDNSLGDPGMRVLCETLQHPGCNIRRLWLGRCGLSHECCFDISLVLSSNQKLVELDLSDNALGDFGIRLLCVGLKHLLCNLKKLWLVSCCLTSACCQDLASVLSTSHSLTRLYVGENALGDSGVAILCEKAKNPQCNLQKLGLVNSGLTSVCCSALSSVLSTNQNLTHLYLRGNTLGDKGIKLLCEGLLHPDCKLQVLELDNCNLTSHCCWDLSTLLTSSQSLRKLSLGNNDLGDLGVMMFCEVLKQQSCLLQNLGLSEMYFNYETKSALETLQEEKPELTVVFEPSW

SEQ ID NO: 9068 - RNA, 3111 nt, Artificial Sequence
  NALP3__Homo_sapiens__AAI43363
augaagauggcaagcacccgcugcaagcuggccagguaccuggaggaccuggaggauguggacuugaagaaauuuaagaugcacuuagaggacuauccuccccagaagggcugcaucccccucccgaggggucagacagagaaggcagaccauguggaucuagccacgcuaaugaucgacuucaauggggaggagaaggcgugggccauggccguguggaucuucgcugcgaucaacaggagagaccuuuaugagaaagcaaaaagagaugagccgaagugggguucagauaaugcacguguuucgaaucccacugugauaugccaggaagacagcauugaagaggaguggauggguuuacuggaguaccuuucgagaaucucuauuuguaaaaugaagaaagauuaccguaagaaguacagaaaguacgugagaagcagauuccagugcauugaagacaggaaugcccgucugggugagagugugagccucaacaaacgcuacacacgacugcgucucaucaaggagcaccggagccagcaggagagggagcaggagcuucuggccaucggcaagaccaagacgugugagagccccgugagucccauuaagauggaguugcuguuugaccccgaugaugagcauucugagccugugcacacugugguguuccagggggcggcagggauugggaaaacaauccuggccaggaagaugauguuggacugggcgucggggacacucuaccaagacagguuugacuaucuguucuauauccacugucgggaggugagccuugugacacagaggagccugggggaccugaucaugagcugcugccccgacccaaacccacccauccacaagaucgugagaaaacccuccagaauccucuuccucauggacggcuucgaugagcugcaaggugccuuugacgagcacauaggaccgcucugcacugacuggcagaaggccgagcggggagacauucuccugagcagccucaucagaaagaagcugcuucccgaggccucucugcucaucaccacgagaccuguggcccuggagaaacugcagcacuugcuggaccauccucggcauguggagauccuggguuucuccgaggccaaaaggaaagaguacuucuucaaguacuucucugaugaggcccaagccagggcagccuucagucugauucaggagaacgagguccucuucaccaugugcuucaucccccuggucugcuggaucgugugcacuggacugaaacagcagauggagaguggcaagagccuugcccagacauccaagaccaccaccgcgguguacgucuucuuccuuuccaguuugcugcagccccggggagggagccaggagcacggccucugcgcccaccucugggggcucugcucuuuggcugcagauggaaucuggaaccagaaaauccuguuugaggaguccgaccucaggaaucauggacugcagaaggcggaugugucugcuuuccugaggaugaaccuguuccaaaaggaaguggacugcgagaaguucuacagcuucauccacaugacuuuccaggaguucuuugccgccauguacuaccugcuggaagaggaaaaggaaggaaggacgaacguuccagggagucguuugaagcuucccagccgagacgugacaguccuucuggaaaacuauggcaaauucgaaaagggguauuugauuuuuguuguacguuuccucuuuggccugguaaaccaggagaggaccuccuacuuggagaagaaauuaaguugcaagaucucucagcaaaucaggcuggagcugcugaaauggauugaagugaaagccaaagcuaaaaagcugcagauccagcccagccagcuggaauuguucuacuguuuguacgagaugcaggaggaggacuucgugcaaagggccauggacuauuuccccaagauugagaucaaucucuccaccagaauggaccacaugguuucuuccuuuugcauugagaacugucaucggguggagucacugucccugggguuucuccauaacaugcccaaggaggaagaggaggaggaaaaggaaggccgacaccuugauauggugcaguguguccucccaagcuccucucaugcugccuguucucauggauuggugaacagccaccucacuuccaguuuuugccggggccucuuuucaguucugagcaccagccagagucuaacugaauuggaccucagugacaauucucugggggacccagggaugagaguguugugugaaacgcuccagcauccuggcuguaacauucggagauugugguuggggcgcuguggccucucgcaugagugcugcuucgacaucuccuugguccucagcagcaaccagaagcugguggagcuggaccugagugacaacgcccucggugacuucggaaucagacuucugugugugggacugaagcaccuguugugcaaucugaagaagcucugguuggucagcugcugccucacaucagcauguugucaggaucuugcaucaguauugagcaccagccauucccugaccagacucuaugugggggagaaugccuugggagacucaggagucgcaauuuuaugugaaaaagccaagaauccacaguguaaccugcagaaacugggguuggugaauucuggccuuacgucagucuguuguucagcuuuguccucgguacucagcacuaaucagaaucucacgcaccuuuaccugcgaggcaacacucucggagacaaggggaucaaacuacucugugagggacucuugcaccccgacugcaagcuucagguguuggaauuagacaacugcaaccucacgucacacugcugcugggaucuuuccacacuucugaccuccagccagagccugcgaaagcugagccugggcaacaaugaccugggcgaccugggggucaugauguucugugaagugcugaaacagcagagcugccuccugcagaaccugggguugucugaaauguauuucaauuaugagacaaaaagugcguuagaaacacuucaagaagaaaagccugagcugaccgucgucuuugagccuucuugguag

SEQ ID NO: 9069 - RNA, 3111 nt, Artificial Sequence
  derived and/or modified sequence opt1 from NALP3__Homo_sapiens__AAI43363
augaagauggccagcacccgcugcaagcuggcccgguaccucgaggaccuggaggacguggaccugaagaaguucaagaugcaccucgaggacuacccgccccagaagggcugcaucccccugccccgcgggcagaccgagaaggcggaccacgucgaccuggccacgcucaugaucgacuucaacggcgaggagaaggccugggccauggccguguggaucuucgcggccaucaaccggcgcgaccuguacgagaaggccaagcgggacgagcccaaguggggguccgacaacgcccgcgugagcaacccgaccgucaucugccaggaggacuccaucgaggaggaguggaugggccugcucgaguaccugagccggaucuccaucugcaagaugaagaaggacuaccgcaagaaguaccggaaguacgugcgcagccgguuccagugcaucgaggaccgcaacgcgcggcugggggaguccgugagccucaacaagcgcuacacccggcugcgccugaucaaggagcaccggucccagcaggagcgcgagcaggagcuccuggccaucggcaagaccaagacgugcgagagccccgucucccccaucaagauggagcugcuguucgaccccgacgacgagcacagcgagccggugcacaccguggucuuccagggcgccgccgggaucggcaagaccauccuggcccggaagaugaugcuggacugggcguccgggacccucuaccaggaccgcuucgacuaccuguucuacauccacugccgggaggugagccuggugacgcagcgcucccucggcgaccugaucaugagcugcugccccgaccccaacccgcccauccacaagaucguccgcaagcccucccggauccuguuccucauggacggguucgacgagcugcagggcgccuucgacgagcacaucggcccccugugcaccgacuggcagaaggccgagcgcggggacauccuccugagcucccugauccggaagaagcuccugcccgaggccagccugcucaucaccacccgcccgguggcccuggagaagcugcagcaccuccuggaccacccccggcacguggagauccugggcuucagcgaggcgaagcgcaaggaguacuucuucaaguacuucuccgacgaggcccaggcccgggccgccuucagccucauccaggagaacgagguccuguucacgaugugcuucaucccccuggugugcuggaucgugugcaccgggcucaagcagcagauggaguccggcaagagccuggcgcagaccuccaagaccacgaccgccgucuacguguucuuccugagcucccuccugcagccccgcggcgggagccaggagcacggccugugcgcccaccugugggggcucugcucccuggccgccgacggcaucuggaaccagaagauccuguucgaggagagcgaccuccggaaccacgggcugcagaaggcggacguguccgccuuccugcgcaugaaccucuuccagaaggaggucgacugcgagaaguucuacagcuucauccacaugaccuuccaggaguucuucgccgccauguacuaccugcuggaggaggagaaggagggccggaccaacgugccgggcucccgccucaagcugcccagccgggacgugacgguccugcucgagaacuacgggaaguucgagaagggcuaccugaucuucgugguccgcuuccuguucgggcucgugaaccaggagcggaccuccuaccuggagaagaagcugagcugcaagaucucccagcagauccgccucgagcugcugaaguggaucgaggugaaggcgaaggccaagaagcuccagauccagcccagccagcuggagcuguucuacugccucuacgagaugcaggaggaggacuucguccagcgggccauggacuacuuccccaagaucgagaucaaccuguccacccgcauggaccacauggugagcagcuucugcaucgagaacugccaccggguggagucccugagccucggcuuccugcacaacaugccgaaggaggaggaggaggaggagaaggaggggcgccaccuggacaugguccagugcgugcuccccuccagcucccacgccgccugcagccacggccuggugaacucccaccugaccagcuccuucugccgcggccucuucagcguccuguccacgagccagucccugaccgagcucgaccugagcgacaacucccugggggaccccggcaugcgggugcucugcgagacccugcagcaccccgggugcaacauccgccggcuguggcucggccgcugcgggcugagccacgagugcugcuucgacaucucccuggugcucagcagcaaccagaagcuggucgagcuggaccucuccgacaacgcgcugggcgacuucggcauccggcugcucugcguggggcugaagcaccuccucugcaaccugaagaagcuguggcucgugagcugcugccugaccuccgccugcugccaggaccuggccagcguccucuccacgagccacucccugacccgccuguacgugggcgagaacgcccucggggacagcggcguggccauccugugcgagaaggcgaagaacccgcagugcaaccugcagaagcucggccuggucaacuccgggcugaccagcgugugcugcuccgcccucagcuccgugcugagcaccaaccagaaccugacgcaccucuaccugcggggcaacacccugggggacaagggcaucaagcuccugugcgaggggcugcuccaccccgacugcaagcugcagguccuggagcucgacaacugcaaccugaccucccacugcugcugggaccugagcacccuccugacguccagccagucccugcgcaagcucagccugggcaacaacgaccugggcgaccucggggugaugauguucugcgaggugcugaagcagcagagcugccugcuccagaaccugggccuguccgagauguacuucaacuacgagaccaagagcgcccuggagacccuccaggaggagaagcccgagcugaccgucguguucgagccguccugguga

SEQ ID NO: 9070 - RNA, 3111 nt, Artificial Sequence
  derived and/or modified sequence opt2 from NALP3__Homo_sapiens__AAI43363
augaagauggccuccacccgcugcaagcucgcccgcuaccucgaggaccucgaggacgucgaccucaagaaguucaagaugcaccucgaggacuaccccccccagaagggcugcaucccccucccccgcggccagaccgagaaggccgaccacgucgaccucgccacccucaugaucgacuucaacggcgaggagaaggccugggccauggccgucuggaucuucgccgccaucaaccgccgcgaccucuacgagaaggccaagcgcgacgagcccaaguggggcuccgacaacgcccgcgucuccaaccccaccgucaucugccaggaggacuccaucgaggaggaguggaugggccuccucgaguaccucucccgcaucuccaucugcaagaugaagaaggacuaccgcaagaaguaccgcaaguacguccgcucccgcuuccagugcaucgaggaccgcaacgcccgccucggcgaguccgucucccucaacaagcgcuacacccgccuccgccucaucaaggagcaccgcucccagcaggagcgcgagcaggagcuccucgccaucggcaagaccaagaccugcgagucccccgucucccccaucaagauggagcuccucuucgaccccgacgacgagcacuccgagcccguccacaccgucgucuuccagggcgccgccggcaucggcaagaccauccucgcccgcaagaugaugcucgacugggccuccggcacccucuaccaggaccgcuucgacuaccucuucuacauccacugccgcgaggucucccucgucacccagcgcucccucggcgaccucaucauguccugcugccccgaccccaacccccccauccacaagaucguccgcaagcccucccgcauccucuuccucauggacggcuucgacgagcuccagggcgccuucgacgagcacaucggcccccucugcaccgacuggcagaaggccgagcgcggcgacauccuccucuccucccucauccgcaagaagcuccuccccgaggccucccuccucaucaccacccgccccgucgcccucgagaagcuccagcaccuccucgaccacccccgccacgucgagauccucggcuucuccgaggccaagcgcaaggaguacuucuucaaguacuucuccgacgaggcccaggcccgcgccgccuucucccucauccaggagaacgagguccucuucaccaugugcuucaucccccucgucugcuggaucgucugcaccggccucaagcagcagauggaguccggcaagucccucgcccagaccuccaagaccaccaccgccgucuacgucuucuuccucuccucccuccuccagccccgcggcggcucccaggagcacggccucugcgcccaccucuggggccucugcucccucgccgccgacggcaucuggaaccagaagauccucuucgaggaguccgaccuccgcaaccacggccuccagaaggccgacgucuccgccuuccuccgcaugaaccucuuccagaaggaggucgacugcgagaaguucuacuccuucauccacaugaccuuccaggaguucuucgccgccauguacuaccuccucgaggaggagaaggagggccgcaccaacguccccggcucccgccucaagcuccccucccgcgacgucaccguccuccucgagaacuacggcaaguucgagaagggcuaccucaucuucgucguccgcuuccucuucggccucgucaaccaggagcgcaccuccuaccucgagaagaagcucuccugcaagaucucccagcagauccgccucgagcuccucaaguggaucgaggucaaggccaaggccaagaagcuccagauccagcccucccagcucgagcucuucuacugccucuacgagaugcaggaggaggacuucguccagcgcgccauggacuacuuccccaagaucgagaucaaccucuccacccgcauggaccacauggucuccuccuucugcaucgagaacugccaccgcgucgagucccucucccucggcuuccuccacaacaugcccaaggaggaggaggaggaggagaaggagggccgccaccucgacaugguccagugcguccuccccuccuccucccacgccgccugcucccacggccucgucaacucccaccucaccuccuccuucugccgcggccucuucuccguccucuccaccucccagucccucaccgagcucgaccucuccgacaacucccucggcgaccccggcaugcgcguccucugcgagacccuccagcaccccggcugcaacauccgccgccucuggcucggccgcugcggccucucccacgagugcugcuucgacaucucccucguccucuccuccaaccagaagcucgucgagcucgaccucuccgacaacgcccucggcgacuucggcauccgccuccucugcgucggccucaagcaccuccucugcaaccucaagaagcucuggcucgucuccugcugccucaccuccgccugcugccaggaccucgccuccguccucuccaccucccacucccucacccgccucuacgucggcgagaacgcccucggcgacuccggcgucgccauccucugcgagaaggccaagaacccccagugcaaccuccagaagcucggccucgucaacuccggccucaccuccgucugcugcuccgcccucuccuccguccucuccaccaaccagaaccucacccaccucuaccuccgcggcaacacccucggcgacaagggcaucaagcuccucugcgagggccuccuccaccccgacugcaagcuccagguccucgagcucgacaacugcaaccucaccucccacugcugcugggaccucuccacccuccucaccuccucccagucccuccgcaagcucucccucggcaacaacgaccucggcgaccucggcgucaugauguucugcgagguccucaagcagcaguccugccuccuccagaaccucggccucuccgagauguacuucaacuacgagaccaaguccgcccucgagacccuccaggaggagaagcccgagcucaccgucgucuucgagcccuccugguga

SEQ ID NO: 9071 - RNA, 3111 nt, Artificial Sequence
  derived and/or modified sequence opt3 from NALP3__Homo_sapiens__AAI43363
augaagauggccagcaccagaugcaaacuggcuagguaccucgaggaccuugaagauguggaccugaagaaauucaagaugcacuuggaggauuaucccccucagaaaggcuguaucccauuaccgcgggggcaaacagaaaaggcagaccaugucgaucuggccacucuaaugauugacuuuaacggagaggaaaaggcgugggcuauggccguuuggauauucgcagccaucaaucgccgagaucucuacgagaaagcuaagcgugacgagcccaaaugggguuccgauaacgcaagagugucuaauccuacgguaauuugccaggaagacucaaucgaggaagaguggaugggccugcuugaguaucugaguaggauuagcaucuguaagaugaaaaaggauuaccggaagaaauaucgcaaguacgugagauccagguuucagugcauagaagaccggaacgcccgcuugggggagucugucucgcucaauaaacgauauaccagacugaggcugaucaaggaacaccggucacagcaagagcgugaacaggagcucuuagcuauuggaaaaacaaagacuugugagagcccagugagucccaucaaaauggaacugcuuuucgauccugacgacgagcauuccgaaccaguucacaccguggucuuucagggcgccgcggguauugggaagacaaucuuggcacgcaagaugaugcuggauugggccucuggaacccuauaccaggacagauucgauuaccucuuuuauauacauugcagggaggugagccugguaacucaacggucccuuggcgaccugauuaugucauguugccccgauccuaacccaccgauccacaaaauuguucgaaagcccagucgcaucuuguuccucauggacggcuuugaugaacugcagggggcuuucgacgagcacaucggaccuuuauguacagauuggcagaaagccgagagaggugacauucugcucagcucucuuauaaggaagaaacuguugccagaagcaucccuacugaucaccacgcggcccguggcucucgagaagcugcagcaucuucuggaucacccucgccaugucgaaauuuugggcuuuucagaggccaagagaaaagaauacuucuuuaaguauuucagcgacgaggcgcaagccagggcagcuuucagucucauccaggagaaugaagugcuguuuacuaugugcuucauaccauuaguguguuggauugucugcaccgggcugaaacagcaaauggagucuggaaagucccuagcccagacaagcaaaacuaccacagcuguuuacguguuuuuccucucgucucugcuucagccccguggcgguucccaggaacacggguugugcgcccaccuguggggacucuguucacuggcagccgacggcaucuggaaccaaaagauccuuuuugaggagagugaucugcggaaucauggcuugcagaaggcugacguaagcgcguuccuccgaaugaaccuguuucagaaagaaguggauugcgagaaguucuauuccuuuauucacaugaccuuccaggaauuuuucgcagccauguacuauuuacuggaggaagagaaagaggggagaacgaaugucccgggaucuaggcuaaagcucccuagccgcgacgugacuguucugcuugaaaacuacgguaaauuugagaagggcuacuugaucuucgugguccgguuccuguuugggcucgugaaucaagaaagaacaucauaucuggagaagaaauuaaguuguaagauuucccagcagauaaggcuggaacuuuugaaauggaucgagguaaaggcuaaagccaagaaacuccagauucaacccagccagcuggagcuauucuacugccuguaugaaaugcaggaggaagauuuuguucagcgcgcaauggacuacuucccaaagaucgagaucaaccucucuacccgaauggaucauauggugucaaguuuuuguauugaaaauugccaccgggucgagagccugucccuuggauucuugcauaacaugccuaaggaggaagaggaagaggagaaagaaggccgucaccuggacauggugcaaugugucuuacccucuucgagccacgccgcuugcucccauggucucgugaacucacaccugacaaguucuuuuuguagagggcuuuucagcguucuguccacuucacagagcuugaccgagcucgaucugucugacaauucccuaggcgauccaggaaugagggugcugugcgaaacgcuccagcaucccggcuguaacauacgccggcuguggcuugggagaugcggauugagucacgagugcuguuuugacaucagccugguauuaucuuccaaucaaaagcucgucgaacuggaucuuucagacaacgcccugggugacuucggcauuaggcuacucugcguggggcugaaacacuugcuguguaauuuaaagaaacucuggcugguuaguugcugucuuaccagcgcaugcugucaggaucuggcgucgguguuguccacaucucauagccucacucgacuguaugucggagagaacgcucuaggcgacucagguguggccauccugugcgagaaggcaaagaauccucaguguaaccuucagaaacucgggcugguaaauaguggcuugaccuccgugugcuguucugcccugagcuccguuuuaucaacaaaccaaaaucucacucaccuguaccuucgcggaaacacccugggcgauaaggggauuaaauugcucugcgaaggacugcuacauccagacugcaagcugcagguccuugagcucgauaauuguaaccugacaagccacugcuguugggacuugaguaccuuacugacuucuucccagagccuccggaaacugucgcuugguaauaacgaucugggcgacuugggggugaugauguuuugcgaagugcuaaagcagcaaucaugucugcuccagaaccugggacuuucugagauguauuucaauuacgaaacgaagagugcuuuagagacacugcaggaggaaaaaccggagcucaccgucguuuuugaacccuccugguga

SEQ ID NO: 9072 - RNA, 3111 nt, Artificial Sequence
  derived and/or modified sequence opt4 from NALP3__Homo_sapiens__AAI43363
augaagauggccagcaccagaugcaagcuggccagauaccuggaggaccuggaggacguggaccugaagaaguucaagaugcaccuggaggacuaccccccccagaagggcugcaucccccugcccagaggccagaccgagaaggccgaccacguggaccuggccacccugaugaucgacuucaacggcgaggagaaggccugggccauggccguguggaucuucgccgccaucaacagaagagaccuguacgagaaggccaagagagacgagcccaaguggggcagcgacaacgccagagugagcaaccccaccgugaucugccaggaggacagcaucgaggaggaguggaugggccugcuggaguaccugagcagaaucagcaucugcaagaugaagaaggacuacagaaagaaguacagaaaguacgugagaagcagauuccagugcaucgaggacagaaacgccagacugggcgagagcgugagccugaacaagagauacaccagacugagacugaucaaggagcacagaagccagcaggagagagagcaggagcugcuggccaucggcaagaccaagaccugcgagagccccgugagccccaucaagauggagcugcuguucgaccccgacgacgagcacagcgagcccgugcacaccgugguguuccagggcgccgccggcaucggcaagaccauccuggccagaaagaugaugcuggacugggccagcggcacccuguaccaggacagauucgacuaccuguucuacauccacugcagagaggugagccuggugacccagagaagccugggcgaccugaucaugagcugcugccccgaccccaacccccccauccacaagaucgugagaaagcccagcagaauccuguuccugauggacggcuucgacgagcugcagggcgccuucgacgagcacaucggcccccugugcaccgacuggcagaaggccgagagaggcgacauccugcugagcagccugaucagaaagaagcugcugcccgaggccagccugcugaucaccaccagacccguggcccuggagaagcugcagcaccugcuggaccaccccagacacguggagauccugggcuucagcgaggccaagagaaaggaguacuucuucaaguacuucagcgacgaggcccaggccagagccgccuucagccugauccaggagaacgaggugcuguucaccaugugcuucaucccccuggugugcuggaucgugugcaccggccugaagcagcagauggagagcggcaagagccuggcccagaccagcaagaccaccaccgccguguacguguucuuccugagcagccugcugcagcccagaggcggcagccaggagcacggccugugcgcccaccuguggggccugugcagccuggccgccgacggcaucuggaaccagaagauccuguucgaggagagcgaccugagaaaccacggccugcagaaggccgacgugagcgccuuccugagaaugaaccuguuccagaaggagguggacugcgagaaguucuacagcuucauccacaugaccuuccaggaguucuucgccgccauguacuaccugcuggaggaggagaaggagggcagaaccaacgugcccggcagcagacugaagcugcccagcagagacgugaccgugcugcuggagaacuacggcaaguucgagaagggcuaccugaucuucguggugagauuccuguucggccuggugaaccaggagagaaccagcuaccuggagaagaagcugagcugcaagaucagccagcagaucagacuggagcugcugaaguggaucgaggugaaggccaaggccaagaagcugcagauccagcccagccagcuggagcuguucuacugccuguacgagaugcaggaggaggacuucgugcagagagccauggacuacuuccccaagaucgagaucaaccugagcaccagaauggaccacauggugagcagcuucugcaucgagaacugccacagaguggagagccugagccugggcuuccugcacaacaugcccaaggaggaggaggaggaggagaaggagggcagacaccuggacauggugcagugcgugcugcccagcagcagccacgccgccugcagccacggccuggugaacagccaccugaccagcagcuucugcagaggccuguucagcgugcugagcaccagccagagccugaccgagcuggaccugagcgacaacagccugggcgaccccggcaugagagugcugugcgagacccugcagcaccccggcugcaacaucagaagacuguggcugggcagaugcggccugagccacgagugcugcuucgacaucagccuggugcugagcagcaaccagaagcugguggagcuggaccugagcgacaacgcccugggcgacuucggcaucagacugcugugcgugggccugaagcaccugcugugcaaccugaagaagcuguggcuggugagcugcugccugaccagcgccugcugccaggaccuggccagcgugcugagcaccagccacagccugaccagacuguacgugggcgagaacgcccugggcgacagcggcguggccauccugugcgagaaggccaagaacccccagugcaaccugcagaagcugggccuggugaacagcggccugaccagcgugugcugcagcgcccugagcagcgugcugagcaccaaccagaaccugacccaccuguaccugagaggcaacacccugggcgacaagggcaucaagcugcugugcgagggccugcugcaccccgacugcaagcugcaggugcuggagcuggacaacugcaaccugaccagccacugcugcugggaccugagcacccugcugaccagcagccagagccugagaaagcugagccugggcaacaacgaccugggcgaccugggcgugaugauguucugcgaggugcugaagcagcagagcugccugcugcagaaccugggccugagcgagauguacuucaacuacgagaccaagagcgcccuggagacccugcaggaggagaagcccgagcugaccgugguguucgagcccagcugguga

SEQ ID NO: 9073 - RNA, 3111 nt, Artificial Sequence
  derived and/or modified sequence opt5 from NALP3__Homo_sapiens__AAI43363
augaagauggccagcaccagaugcaaacuggcucgguaccucgaggaccuggaagauguggaccuuaagaaauucaagaugcaccuggaggauuaucccccucagaaaggcuguaucccgcucccccgcgggcaaacagaaaaggccgaccaugucgaucuggcgacgcuuaugauugacuuuaacggagaggaaaaggcuugggccauggccguuuggaucuucgcugccauuaauagacgggaucuguacgagaaagcuaagcgcgacgagccuaaauggggcuccgauaacgccagagugucuaaucccaccgugaucugccaggaagacagcauugaggaagaguggauggggcuccuggaguaucugucccggaucucuaucuguaagaugaaaaaggauuaccgcaagaaauauagaaaguacguccggagccgcuuucagugcauugaagacagaaacgcgcggcucggagaguccgugucucugaauaaacgcuauacaagacuucggcugaucaaggaacaccgcagccagcaagagagagaacaggagcuccuggccauuggcaaaaccaagacaugugaguccccuguuagccccaucaaaauggaacuucuguucgauccugacgacgagcauucugaaccggugcacaccgucguguuucagggggcugccggaauuggcaagacaauccucgcucggaagaugaugcuggauugggccuccggcacccuguaccaggacagauucgauuaccucuuuuauauucauugccgcgagguuagccuggugacgcaacggucucuuggggaccugaucauguccuguugccccgauccuaaucccccuauccacaaaauugucagaaagcccagccgcauccucuuccugauggacggauuugaugaacuucagggcgcguucgacgagcacauugggccgcuguguaccgauuggcagaaagccgagcggggagacauccuccugucuucccugauuagaaagaaacuccugccugaagcuagccuucugaucacaacccgccccguggcccucgagaagcugcagcaucuucuggaucacccucggcauguggaaauccucggcuuuuccgaggcuaagagaaaagaauacuucuuuaaguauuucucugacgaggcccaagcccgcgcugcguucagccugauucaggagaacgaaguccuguuuacaaugugcuucaucccccucguuuguuggauugugugcaccgggcugaaacagcaaauggaguccggaaagagccuugcccagacgucuaaaacaaccacagcuguguacgucuuuuuccuguccagccuccugcagccccggggcggcucucaggaacacgggcugugcgcccaccuuuggggacucuguagccuggccgcugacggcaucuggaaccaaaagauucuguuugaggaguccgaucucagaaaucaugggcugcagaaggccgacgugucugcguuccuucgcaugaaccuguuucagaaagaaguugauugcgagaaguucuauagcuuuauccacaugaccuuccaggaauuuuucgcugccauguacuaucuccuggaggaagagaaagagggacggaccaaugugccuggcuccagacugaagcugccgagccgggacgucacagugcuccuggaaaacuacgggaaauuugagaagggauaccugaucuucguugugcgcuuccucuuuggccuggucaaucaagaaagaacgucuuaucuugagaagaaacuguccuguaagauuagccagcagauccggcucgaacugcugaaauggauugaggugaaggccaaagcuaagaaacuucagauccaacccucucagcucgagcuguucuacugccuguaugaaaugcaggaggaagauuuuguccagagagccauggacuacuucccuaagauugagaucaaccucuccacccgcauggaucauauggugagcuccuuuuguauugaaaauugccaccggguugagucucugagccuuggcuuccugcauaacaugcccaaggaggaagaggaagaggagaaagaagggagacaccucgacauggugcaauguguccugccuuccucuagccacgcugccugcucccauggacuggugaacagccaccuuacaucuuccuuuugucgcggccucuucagcguucugucuaccucccagagccugacagagcucgaucugucugacaauagccuuggggaucccggaaugagagugcugugcgaaacccuccagcauccgggcuguaacauccggcgccuguggcuggggagaugcggccuuucccacgagugcuguuuugacaucagccugguccucucuuccaaucaaaagcugguggaacucgaucugagcgacaacgcgcuuggagacuucggcauucggcugcucugcguggggcugaaacaccuucuuuguaaucugaagaaacucuggcugguuuccugcugucucacgucugccugcugucaggaucuggcuagcguccuuuccacaucucauagccugacccgccucuaugugggagagaacgcccugggcgacuccgggguggcuauccugugcgagaaggccaagaauccucaguguaaccuucagaaacugggacucgucaauucuggccugaccagcgugugcuguuccgcgcucagcucuguucuguccacaaaccaaaaucuuacccaccuguaccugagagggaacacacucggcgauaagggaauuaaacugcuuugcgaaggccugcuccaucccgacugcaagcuccaggugcuggagcuggauaauuguaaccuuacgagccacugcuguugggaccugucuacccugcucacauccagccagucucugcggaaacuuucccuggggaauaacgaucucggagaccugggcgucaugauguuuugcgaagugcucaagcagcaaagcugucugcuucagaaccuggggcuguccgagauguauuucaauuacgaaaccaagagcgcccucgagacacugcaggaggaaaaaccugagcuuaccguuguguuugaacccucuugguga

SEQ ID NO: 9074 - protein, 994 aa, Artificial Sequence
  NALP4__Homo_sapiens__Q96MN2
MAASFFSDFGLMWYLEELKKEEFRKFKEHLKQMTLQLELKQIPWTEVKKASREELANLLIKHYEEQQAWNITLRIFQKMDRKDLCMKVMRERTGYTKTYQAHAKQKFSRLWSSKSVTEIHLYFEEEVKQEECDHLDRLFAPKEAGKQPRTVIIQGPQGIGKTTLLMKLMMAWSDNKIFRDRFLYTFYFCCRELRELPPTSLADLISREWPDPAAPITEIVSQPERLLFVIDSFEELQGGLNEPDSDLCGDLMEKRPVQVLLSSLLRKKMLPEASLLIAIKPVCPKELRDQVTISEIYQPRGFNESDRLVYFCCFFKDPKRAMEAFNLVRESEQLFSICQIPLLCWILCTSLKQEMQKGKDLALTCQSTTSVYSSFVFNLFTPEGAEGPTPQTQHQLKALCSLAAEGMWTDTFEFCEDDLRRNGVVDADIPALLGTKILLKYGERESSYVFLHVCIQEFCAALFYLLKSHLDHPHPAVRCVQELLVANFEKARRAHWIFLGCFLTGLLNKKEQEKLDAFFGFQLSQEIKQQIHQCLKSLGERGNPQGQVDSLAIFYCLFEMQDPAFVKQAVNLLQEANFHIIDNVDLVVSAYCLKYCSSLRKLCFSVQNVFKKEDEHSSTSDYSLICWHHICSVLTTSGHLRELQVQDSTLSESTFVTWCNQLRHPSCRLQKLGINNVSFSGQSVLLFEVLFYQPDLKYLSFTLTKLSRDDIRSLCDALNYPAGNVKELALVNCHLSPIDCEVLAGLLTNNKKLTYLNVSCNQLDTGVPLLCEALCSPDTVLVYLMLAFCHLSEQCCEYISEMLLRNKSVRYLDLSANVLKDEGLKTLCEALKHPDCCLDSLCLVKCFITAAGCEDLASALISNQNLKILQIGCNEIGDVGVQLLCRALTHTDCRLEILGLEECGLTSTCCKDLASVLTCSKTLQQLNLTLNTLDHTGVVVLCEALRHPECALQVLGLRKTDFDEETQALLTAEEERNPNLTITDDCDTITRVEI

SEQ ID NO: 9075 - RNA, 2985 nt, Artificial Sequence
  NALP4__Homo_sapiens__CCDS12936.1
auggcagccucuuucuucucugauuuuggucuuaugugguaucuggaggagcucaaaaaggaggaguucaggaaauuuaaagaacaucucaagcaaaugacuuugcagcuugaacucaagcagauucccuggacugaggucaaaaaagcaucccgggaagaacuugcaaaccucuugaucaagcacuaugaagaacaacaagcuuggaacauaaccuuaagaaucuuucaaaagauggauagaaaggaucucugcaugaaggucaugagggagagaacaggauacacaaagaccuaucaagcucacgcaaagcagaaauucagccgcuuaugguccagcaagucugucacugagauucaccuauacuuugaggaggaagucaagcaagaagaaugugaccauuuggaccgccuuuuugcucccaaggaagcugggaaacagccacguacagugaucauucaaggaccacaaggaauuggaaaaacgacacuccugaugaagcugaugauggccuggucggacaacaagaucuuucgggauagguuccuguacacguucuauuucugcugcagagaacugagggaguugccgccaacgaguuuggcugacuugauuuccagagaguggccugaccccgcugcuccuauaacagagaucgugucucaaccggagagacucuuguucgucaucgacagcuucgaagagcugcagggcggcuugaacgaacccgauucggaucuguguggugacuugauggagaaacggccggugcaggugcuucugagcaguuugcugaggaagaagaugcucccggaggccucccugcucaucgcuaucaaacccgugugcccgaaggagcuccgggaucaggugacgaucucagaaaucuaccagccccggggauucaacgagagugauagguuaguguauuucugcuguuucuucaaagacccgaaaagagccauggaagccuucaaucuuguaagagaaagugaacagcuguuuuccauaugccaaaucccgcuccucugcuggauccuguguaccagucugaagcaagagaugcagaaaggaaaagaccuggcccugaccugccagagcacuaccucuguguacuccucuuucgucuuuaaccuguucacaccugagggugccgagggcccgacuccgcaaacccagcaccagcugaaggcccugugcucccuggcugcagaggguauguggacagacacauuugaguuuugugaagacgaccuccggagaaaugggguuguugacgcugacaucccugcgcugcugggcaccaagauacuucugaaguacggggagcgugagagcuccuacguguuccuccacguguguauccaggaguucugugccgccuuguucuauuugcucaagagccaccuugaucauccucacccagcugugagauguguacaggaauugcuaguugccaauuuugaaaaagcaaggagagcacauuggauuuuuuugggguguuuucuaacuggccuuuuaaauaaaaaggaacaagaaaaacuggaugcguuuuuuggcuuccaacugucccaagagauaaagcagcaaauucaccagugccugaagagcuuaggggagcguggcaauccucagggacagguggauuccuuggcgauauuuuacugucucuuugaaaugcaggauccugccuuugugaagcaggcagugaaccuccuccaagaagcuaacuuucauauuauugacaacguggacuuggugguuucugccuacugcuuaaaauacugcuccagcuugaggaaacucuguuuuuccguucaaaaugucuuuaagaaagaggaugaacacagcucuacgucggauuacagccucaucuguuggcaucacaucugcucugugcucaccaccagcgggcaccucagagagcuccaggugcaggacagcacccucagcgagucgaccuuugugaccugguguaaccagcugaggcaucccagcugucgccuucagaagcuuggaauaaauaacguuuccuuuucuggccagaguguucugcucuuugaggugcucuuuuaucagccagacuugaaauaccugagcuucacccucacgaaacucucucgugaugacaucaggucccucugugaugccuugaacuacccagcaggcaacgucaaagagcuagcgcugguaaauugucaccucucacccauugauugugaaguccuugcuggccuucuaaccaacaacaagaagcugacguaucugaauguauccugcaaccaguuagacacaggcgugccccuuuugugugaagcccugugcagcccagacacgguccugguauaccugauguuggcuuucugccaccucagcgagcagugcugcgaauacaucucugaaaugcuucugcguaacaagagcgugcgcuaucuagaccucagugccaauguccugaaggacgaaggacugaaaacucucugcgaggccuugaaacauccggacugcugccuggauucacuguguuugguaaaauguuuuaucacugcugcuggcugugaagaccucgccucugcucucaucagcaaucaaaaccugaagauucugcaaauugggugcaaugaaaucggagaugugggugugcagcuguugugucgggcucugacgcauacggauugccgcuuagagauucuuggguuggaagaauguggguuaacgagcaccugcuguaaggaucucgcgucuguucucaccugcaguaagacccugcagcagcucaaccugaccuugaacaccuuggaccacacaggggugguuguacucugugaggcccugagacacccagagugugcccugcaggugcucgggcugagaaaaacugauuuugaugaggaaacccaggcacuucugacggcugaggaagagagaaauccuaaccugaccaucacagacgacugugacacaaucacaaggguagagaucuga

SEQ ID NO: 9076 - RNA, 2985 nt, Artificial Sequence
  derived and/or modified sequence opt1 from NALP4__Homo_sapiens__CCDS12936.1
auggccgccagcuucuucuccgacuucggccugaugugguaccucgaggagcugaagaaggaggaguuccgcaaguucaaggagcaccugaagcagaugacccuccagcuggagcugaagcagauccccuggaccgaggugaagaaggcgagccgggaggagcucgccaaccugcugaucaagcacuacgaggagcagcaggccuggaacaucacgcuccgcaucuuccagaagauggaccggaaggaccugugcaugaaggucaugcgcgagcggaccggguacaccaagaccuaccaggcccacgccaagcagaaguucucccgccuguggagcuccaagagcgugacggagauccaccucuacuucgaggaggaggugaagcaggaggagugcgaccaccuggaccggcuguucgcgccgaaggaggccggcaagcagccccgcaccgucaucauccaggggccccagggcaucgggaagaccacccuccugaugaagcugaugauggccugguccgacaacaagaucuuccgggaccgcuuccucuacacguucuacuucugcugccgggagcugcgcgagcugcccccgaccagccucgccgaccugaucucccgggaguggcccgaccccgcggcccccaucaccgagaucgugagccagccggagcgccuccucuucgugaucgacuccuucgaggagcugcagggcggccugaacgagcccgacagcgaccucugcggggaccugauggagaagcggcccguccaggugcugcucuccagccugcugcgcaagaagaugcuccccgaggccucccugcugaucgccaucaagccggugugccccaaggagcuccgggaccaggucaccaucagcgagaucuaccagccccgcggcuucaacgaguccgaccggcugguguacuucugcugcuucuucaaggaccccaagcgcgccauggaggcguucaaccuggugcgggagagcgagcagcuguucuccaucugccagaucccgcugcugugcuggauccucugcacgagccugaagcaggagaugcagaaggggaaggaccuggcccugaccugccagagcaccaccuccgucuacagcuccuucguguucaaccuguucacgcccgagggcgccgaggggcccacgccccagacccagcaccagcugaaggcccucugcagccuggccgcggagggcauguggaccgacaccuucgaguucugcgaggacgaccugcgccgcaacggcguggucgacgccgacaucccggcccugcucgggaccaagauccugcugaaguacggcgagcgggaguccagcuacguguuccuccacgugugcauccaggaguucugcgccgcccuguucuaccugcucaagucccaccuggaccacccccaccccgcgguccgcugcgugcaggagcugcucguggccaacuucgagaaggcccggcgcgcccacuggaucuuccuggggugcuuccugaccggccuccugaacaagaaggagcaggagaagcuggacgccuucuucggcuuccagcucagccaggagaucaagcagcagauccaccagugccugaagucccugggggagcggggcaacccccaggggcaggucgacagccucgcgaucuucuacugccuguucgagaugcaggacccggccuucgugaagcaggccgugaaccugcuccaggaggccaacuuccacaucaucgacaacgucgaccugguggucuccgcguacugccugaaguacugcagcucccuccgcaagcugugcuucagcgugcagaacguguucaagaaggaggacgagcacuccagcaccuccgacuacagccugaucugcuggcaccacaucugcuccguccucacgaccagcggccaccuccgggagcuccaggugcaggacagcacccucuccgagagcaccuucgugacguggugcaaccagcugcgccaccccuccugccggcugcagaagcucgggaucaacaacgucagcuucuccggccagagcgugcugcuguucgaggugcuguucuaccagcccgaccugaaguaccuguccuucacccucaccaagcugagccgcgacgacauccggucccugugcgacgcccucaacuaccccgccggcaacgucaaggagcuggcccuggugaacugccaccucagcccgaucgacugcgaggugcuggccgggcugcucaccaacaacaagaagcugacguaccugaacgucuccugcaaccagcucgacaccggcgugccccugcugugcgaggcgcucugcagccccgacaccgugcuggucuaccugaugcucgccuucugccaccuguccgagcagugcugcgaguacaucagcgagaugcugcuccgcaacaaguccgugcgguaccuggaccugagcgccaacgugcucaaggacgaggggcugaagacccugugcgaggcccucaagcacccggacugcugccuggacucccugugccucgucaagugcuucaucacggccgcgggcugcgaggaccuggccagcgcccugaucagcaaccagaaccucaagauccugcagaucgggugcaacgagaucggcgacgugggcgugcagcugcucugccgcgcccugacccacaccgacugccggcuggagauccucgggcuggaggagugcggccugaccuccacgugcugcaaggaccucgccagcguccugaccugcuccaagacccugcagcagcucaaccugacccugaacacccucgaccacacggggguggugguccugugcgaggcgcugcgccaccccgagugcgcccuccaggugcugggccugcggaagaccgacuucgacgaggagacccaggcccuccugaccgccgaggaggagcgcaaccccaaccugacgaucaccgacgacugcgacaccaucacccggguggagaucuga

SEQ ID NO: 9077 - RNA, 2985 nt, Artificial Sequence
  derived and/or modified sequence opt2 from NALP4__Homo_sapiens__CCDS12936.1
auggccgccuccuucuucuccgacuucggccucaugugguaccucgaggagcucaagaaggaggaguuccgcaaguucaaggagcaccucaagcagaugacccuccagcucgagcucaagcagauccccuggaccgaggucaagaaggccucccgcgaggagcucgccaaccuccucaucaagcacuacgaggagcagcaggccuggaacaucacccuccgcaucuuccagaagauggaccgcaaggaccucugcaugaaggucaugcgcgagcgcaccggcuacaccaagaccuaccaggcccacgccaagcagaaguucucccgccucugguccuccaaguccgucaccgagauccaccucuacuucgaggaggaggucaagcaggaggagugcgaccaccucgaccgccucuucgcccccaaggaggccggcaagcagccccgcaccgucaucauccagggcccccagggcaucggcaagaccacccuccucaugaagcucaugauggccugguccgacaacaagaucuuccgcgaccgcuuccucuacaccuucuacuucugcugccgcgagcuccgcgagcucccccccaccucccucgccgaccucaucucccgcgaguggcccgaccccgccgcccccaucaccgagaucgucucccagcccgagcgccuccucuucgucaucgacuccuucgaggagcuccagggcggccucaacgagcccgacuccgaccucugcggcgaccucauggagaagcgccccguccagguccuccucuccucccuccuccgcaagaagaugcuccccgaggccucccuccucaucgccaucaagcccgucugccccaaggagcuccgcgaccaggucaccaucuccgagaucuaccagccccgcggcuucaacgaguccgaccgccucgucuacuucugcugcuucuucaaggaccccaagcgcgccauggaggccuucaaccucguccgcgaguccgagcagcucuucuccaucugccagaucccccuccucugcuggauccucugcaccucccucaagcaggagaugcagaagggcaaggaccucgcccucaccugccaguccaccaccuccgucuacuccuccuucgucuucaaccucuucacccccgagggcgccgagggccccaccccccagacccagcaccagcucaaggcccucugcucccucgccgccgagggcauguggaccgacaccuucgaguucugcgaggacgaccuccgccgcaacggcgucgucgacgccgacauccccgcccuccucggcaccaagauccuccucaaguacggcgagcgcgaguccuccuacgucuuccuccacgucugcauccaggaguucugcgccgcccucuucuaccuccucaagucccaccucgaccacccccaccccgccguccgcugcguccaggagcuccucgucgccaacuucgagaaggcccgccgcgcccacuggaucuuccucggcugcuuccucaccggccuccucaacaagaaggagcaggagaagcucgacgccuucuucggcuuccagcucucccaggagaucaagcagcagauccaccagugccucaagucccucggcgagcgcggcaacccccagggccaggucgacucccucgccaucuucuacugccucuucgagaugcaggaccccgccuucgucaagcaggccgucaaccuccuccaggaggccaacuuccacaucaucgacaacgucgaccucgucgucuccgccuacugccucaaguacugcuccucccuccgcaagcucugcuucuccguccagaacgucuucaagaaggaggacgagcacuccuccaccuccgacuacucccucaucugcuggcaccacaucugcuccguccucaccaccuccggccaccuccgcgagcuccagguccaggacuccacccucuccgaguccaccuucgucaccuggugcaaccagcuccgccaccccuccugccgccuccagaagcucggcaucaacaacgucuccuucuccggccaguccguccuccucuucgagguccucuucuaccagcccgaccucaaguaccucuccuucacccucaccaagcucucccgcgacgacauccgcucccucugcgacgcccucaacuaccccgccggcaacgucaaggagcucgcccucgucaacugccaccucucccccaucgacugcgagguccucgccggccuccucaccaacaacaagaagcucaccuaccucaacgucuccugcaaccagcucgacaccggcgucccccuccucugcgaggcccucugcucccccgacaccguccucgucuaccucaugcucgccuucugccaccucuccgagcagugcugcgaguacaucuccgagaugcuccuccgcaacaaguccguccgcuaccucgaccucuccgccaacguccucaaggacgagggccucaagacccucugcgaggcccucaagcaccccgacugcugccucgacucccucugccucgucaagugcuucaucaccgccgccggcugcgaggaccucgccuccgcccucaucuccaaccagaaccucaagauccuccagaucggcugcaacgagaucggcgacgucggcguccagcuccucugccgcgcccucacccacaccgacugccgccucgagauccucggccucgaggagugcggccucaccuccaccugcugcaaggaccucgccuccguccucaccugcuccaagacccuccagcagcucaaccucacccucaacacccucgaccacaccggcgucgucguccucugcgaggcccuccgccaccccgagugcgcccuccagguccucggccuccgcaagaccgacuucgacgaggagacccaggcccuccucaccgccgaggaggagcgcaaccccaaccucaccaucaccgacgacugcgacaccaucacccgcgucgagaucuga

SEQ ID NO: 9078 - RNA, 2985 nt, Artificial Sequence
  derived and/or modified sequence opt3 from NALP4__Homo_sapiens__CCDS12936.1
auggccgcuagcuucuuuuccgacuucggccugaugugguaccucgaggaacuuaagaaagaggaauuuagaaaguucaaagagcaccugaagcagaugaccuugcaauuagaacugaaacagauccccuggacagaggugaagaaggcaucuagggaggaacuagccaaccuccugauuaaacauuaugaggaacagcaggcguggaauauaacucuucggaucuuucaaaagauggaucgcaaagaccugugcaugaaggucaugcgagagcguacgggguacaccaaaacauaucaggcucacgccaagcagaaguucucaagauuguggaguagcaaauccguuacugagauucaucucuacuuugaagaggaagugaagcaggaggaaugugaucaccuggacaggcuguucgcaccuaaagaggccggaaagcaaccacggaccguaaucauucaggguccgcagggcaucgggaaaacaacccucuuaaugaagcugaugauggcuuggucugauaacaaaauauuucgcgacagauuccuuuauacuuuuuacuucugcuguagggaguugcgggaacugcccccuacaucgcuagcagaucucaucucacgcgaguggccagaccccgccgcuccuauuaccgaaaucgugagccagccagagcgacugcuuuuugucauugauaguuucgaagaacugcaaggaggcuugaaugagcccgacuccgaucucugcggugaccugauggaaaagagaccugugcagguuuuacugucuagccuccuuaggaagaaaaugcugccagaggccuccuugcuaaucgcgauaaagccggugugucccaaagaacugcgggaucaggucacgauuucagagaucuaucaaccucguggguucaacgaaagugaccgccucguguacuuuugcuguuucuuuaaggacccaaaaagagcaauggaggccuucaaucugguaagggagagcgaacagcucuuuucuauuugccagaucccccuguuguguuggauccucugcacuucccugaagcaggagaugcaaaagggaaaagauuuagcucugaccugucagucaacaacuagcguuuacaguucuuucguguuuaaccuauucaccccugaaggcgccgagggcccaacaccccagacccagcaucaacucaaggcacugugcucccuugcugccgaggggauguggacggacacuuuugaauuuugcgaggaugacuugcggcgaaauggagucguggaugcggacauuccggcccugcucgguacaaaaauacugcuuaaguauggcgaacgcgagagcucguacguguuucugcacgucuguauccaggaguucugcgcagcuuuguuuuaucuccugaaaucucacuuagaucauccucaccccgccguuagaugugugcaggagcugcuaguagcuaacuucgagaaggccaggcgggcacauuggauuuuccucgggugcuuucugaccggacuuuugaauaagaaagaacaggagaagcuggacgccuucuuuggcuuccaacucucccaggaaaucaaacagcagauacaccaaugucugaagucauuaggugagcgcgggaacccacagggacagguggauagucuggcuauuuucuacugccuuuucgaaaugcaagacccugcguuugucaaacaggcagugaauuugcuccaggaggccaacuuccacaucaucgauaauguugaccugguggucagcgcuuauugucuaaaguacugcuccucucugagaaagcucuguuuuagcgugcagaacguauucaaaaaggaggacgaacauucaaguacuuccgauuauagccugauuugcuggcaccauaucuguucuguucuuacaaccucaggccacuugagggagcugcaagugcaggacaguacguuaagcgaauccaccuuugucacauggugcaaucagcuccgucaucccucuugccggcugcagaaacuuggcauuaacaacgugucguucagcgggcaauccguccuguuguuugaggugcuuuucuaccagccagaucugaaguaccuaucauucacucugaccaaacucagucgagacgauauaagaucucugugugacgcccuuaauuaucccgcaggaaacguuaaggaauuggcccuggugaauugccacuuaagcccuaucgauugugagguacucgcuggucugcuuacaaacaauaaaaagcugacuuaccuaaacgucuccugcaaucagcucgacaccggcgugccacuguugugugaggcccugugcucaccggauacaguuuuaguguaucucaugcuggcauuuugucaccuuagcgaacagugcugugaguacauuucugaaaugcuguugaggaacaaguccguccgcuaucucgaccugagugcgaaugugcuaaaagaugaggggcugaagacccuuugcgaggcucucaaacaucccgacuguugccuggauagcuugugccugguaaaguguuucaucacugccgcaggaugcgaagacuuagccucugcucucaucuccaaccaaaaucugaaaauucuucagauaggcuguaacgagaucggugacguggggguucagcuguugugccgggcccucacgcacacagauuguagacuggaaauucuaggccuggaggaaugcggacuuaccucaacuuguugcaaggaccucgcaaguguccugaccuguagcaagacauugcaacaguuaaaucugacccucaacacucuggaucauacaggcguggugguccuuugcgaggcucugaggcacccugagugugccuugcagguucuagggcugcgcaaaacggacuuugaugaagagacccaggcgcuccugacugccgaagaggaacgaaauccaaaccuuacaaucaccgacgauugcgacacaauuacucggguggagaucuga

SEQ ID NO: 9079 - RNA, 2985 nt, Artificial Sequence
  derived and/or modified sequence opt4 from NALP4__Homo_sapiens__CCDS12936.1
auggccgccagcuucuucagcgacuucggccugaugugguaccuggaggagcugaagaaggaggaguucagaaaguucaaggagcaccugaagcagaugacccugcagcuggagcugaagcagauccccuggaccgaggugaagaaggccagcagagaggagcuggccaaccugcugaucaagcacuacgaggagcagcaggccuggaacaucacccugagaaucuuccagaagauggacagaaaggaccugugcaugaaggugaugagagagagaaccggcuacaccaagaccuaccaggcccacgccaagcagaaguucagcagacuguggagcagcaagagcgugaccgagauccaccuguacuucgaggaggaggugaagcaggaggagugcgaccaccuggacagacuguucgcccccaaggaggccggcaagcagcccagaaccgugaucauccagggcccccagggcaucggcaagaccacccugcugaugaagcugaugauggccuggagcgacaacaagaucuucagagacagauuccuguacaccuucuacuucugcugcagagagcugagagagcugccccccaccagccuggccgaccugaucagcagagaguggcccgaccccgccgcccccaucaccgagaucgugagccagcccgagagacugcuguucgugaucgacagcuucgaggagcugcagggcggccugaacgagcccgacagcgaccugugcggcgaccugauggagaagagacccgugcaggugcugcugagcagccugcugagaaagaagaugcugcccgaggccagccugcugaucgccaucaagcccgugugccccaaggagcugagagaccaggugaccaucagcgagaucuaccagcccagaggcuucaacgagagcgacagacugguguacuucugcugcuucuucaaggaccccaagagagccauggaggccuucaaccuggugagagagagcgagcagcuguucagcaucugccagaucccccugcugugcuggauccugugcaccagccugaagcaggagaugcagaagggcaaggaccuggcccugaccugccagagcaccaccagcguguacagcagcuucguguucaaccuguucacccccgagggcgccgagggccccaccccccagacccagcaccagcugaaggcccugugcagccuggccgccgagggcauguggaccgacaccuucgaguucugcgaggacgaccugagaagaaacggcgugguggacgccgacauccccgcccugcugggcaccaagauccugcugaaguacggcgagagagagagcagcuacguguuccugcacgugugcauccaggaguucugcgccgcccuguucuaccugcugaagagccaccuggaccacccccaccccgccgugagaugcgugcaggagcugcugguggccaacuucgagaaggccagaagagcccacuggaucuuccugggcugcuuccugaccggccugcugaacaagaaggagcaggagaagcuggacgccuucuucggcuuccagcugagccaggagaucaagcagcagauccaccagugccugaagagccugggcgagagaggcaacccccagggccagguggacagccuggccaucuucuacugccuguucgagaugcaggaccccgccuucgugaagcaggccgugaaccugcugcaggaggccaacuuccacaucaucgacaacguggaccugguggugagcgccuacugccugaaguacugcagcagccugagaaagcugugcuucagcgugcagaacguguucaagaaggaggacgagcacagcagcaccagcgacuacagccugaucugcuggcaccacaucugcagcgugcugaccaccagcggccaccugagagagcugcaggugcaggacagcacccugagcgagagcaccuucgugaccuggugcaaccagcugagacaccccagcugcagacugcagaagcugggcaucaacaacgugagcuucagcggccagagcgugcugcuguucgaggugcuguucuaccagcccgaccugaaguaccugagcuucacccugaccaagcugagcagagacgacaucagaagccugugcgacgcccugaacuaccccgccggcaacgugaaggagcuggcccuggugaacugccaccugagccccaucgacugcgaggugcuggccggccugcugaccaacaacaagaagcugaccuaccugaacgugagcugcaaccagcuggacaccggcgugccccugcugugcgaggcccugugcagccccgacaccgugcugguguaccugaugcuggccuucugccaccugagcgagcagugcugcgaguacaucagcgagaugcugcugagaaacaagagcgugagauaccuggaccugagcgccaacgugcugaaggacgagggccugaagacccugugcgaggcccugaagcaccccgacugcugccuggacagccugugccuggugaagugcuucaucaccgccgccggcugcgaggaccuggccagcgcccugaucagcaaccagaaccugaagauccugcagaucggcugcaacgagaucggcgacgugggcgugcagcugcugugcagagcccugacccacaccgacugcagacuggagauccugggccuggaggagugcggccugaccagcaccugcugcaaggaccuggccagcgugcugaccugcagcaagacccugcagcagcugaaccugacccugaacacccuggaccacaccggcgugguggugcugugcgaggcccugagacaccccgagugcgcccugcaggugcugggccugagaaagaccgacuucgacgaggagacccaggcccugcugaccgccgaggaggagagaaaccccaaccugaccaucaccgacgacugcgacaccaucaccagaguggagaucuga

SEQ ID NO: 9080 - RNA, 2985 nt, Artificial Sequence
  derived and/or modified sequence opt5 from NALP4__Homo_sapiens__CCDS12936.1
auggccgcuagcuucuuuuccgacuucggccugaugugguaccucgaggaacugaagaaagaggaauuuagaaaguucaaagagcaccuuaagcagaugacccugcaacucgaacugaaacagauccccuggacagaggugaagaaggccucucgggaggaacuugcgaaccugcucauuaaacauuaugaggaacagcaggcuuggaauaucacgcugcgcauuuuucaaaagauggauagaaaagaccugugcaugaaggucaugcgggagcgcaccggguacacaaaaaccuaucaggcccacgccaagcagaaguucagcagacucugguccucuaaaagcguuacagagauccaucuguacuuugaagaggaagugaagcaggaggaaugugaucaccuugaccggcuguucgcuccuaaagaggccggaaagcaaccgcgcaccgugauuauccagggcccccaggggaucggaaaaacaacccuccugaugaagcucaugauggcuugguccgauaacaaaauuuuuagagaccgguuccuguauacguuuuacuucugcugucgcgagcucagagaacugccucccaccucucuggccgaucucaucagccgggaguggccugaccccgcggccccuauuacagaaaucgucucccagccggagcgccugcuuuuugugauugauagcuucgaggaacugcaaggcgggcucaaugagcccgacucugaucugugcggagaccuuauggaaaagagaccuguucaggugcugcucuccagccugcugcggaagaaaaugcuccccgaggcuucucugcuuaucgccauuaagccugucugucccaaagaacugcgcgaucaggugaccaucuccgagaucuaucaaccgagaggcuucaacgaaagcgaccggcucguuuacuuuugcuguuucuuuaaggacccuaaaagagcuauggaggccuucaaucuggugcgcgagucugaacagcuuuucuccauuugccagaucccccugcucuguuggauucugugcacaagccugaagcaggagaugcaaaagggcaaagaucucgcgcugaccugucaguccacgacaucugucuacagcuccuucguguuuaaccuuuucaccccugaaggggccgagggacccacaccccagacccagcaucaacugaaggcucucugcagccuggccgcugagggcauguggaccgacacauuugaauuuugcgaggaugaccugcggagaaaugggguggucgaugccgacaucccugcccuucucggaacgaaaauucugcugaaguauggcgaacgcgagucuuccuacguuuuucuccacguguguauccaggaauuuugcgcugcgcuguuuuaucuucugaaaagccaccucgaucauccgcaccccgccgugcgguguguccaggagcugcugguggcuaacuucgagaaggccagacgcgcccauuggaucuuccuugggugcuuucucaccggacugcugaauaagaaagaacaggagaagcucgacgcuuucuuuggcuuccaacugucucaggaaauuaaacagcagauccaccaaugucuuaagagccugggcgagcgggggaacccucagggacagguugauucccucgccauuuucuacugccuguucgaaaugcaagaccccgcguuugugaaacaggcugucaaucugcuucaggaggccaacuuccacaucauugauaauguggaccucguugugucugccuauugucugaaguacugcagcucccugagaaagcucuguuuuagcguccagaacguguucaaaaaggaggacgaacauucuuccacaagcgauuauucucugaucugcuggcaccauaucuguuccguccuuaccacaagcggccaucugcgcgagcuccaagugcaggacuccacccugucugaaagcacguuuguuacauggugcaaucagcugcggcacccuuccugcagacuucagaaacucgggauuaacaacgugucuuucagcggacaauccguccugcuguuugaggugcuuuucuaccagcccgaucugaaguaccuuagcuucacccugaccaaacucucucgcgacgauauccggucccugugugacgcucugaauuauccggccggcaacguuaaggaacuugcucuggugaauugccaccucagcccuauugauugugagguccuggccgggcuccugacaaacaauaaaaagcugaccuaccugaacgugucuugcaaucagcucgacacaggagugccccugcugugugaggcgcuuugcuccccugauacgguucuggucuaucucaugcuggccuuuugucaccucagcgaacagugcugugaguacaucucugaaaugcugcuuagaaacaagagcgugcgguaucuggaccucuccgcuaaugugcugaaagaugagggccugaagacccuuugcgaggcccugaaacaucccgacuguugccucgauagccugugccucgucaaguguuucauuacagcugccggcugcgaagaccuggcgucugcccuuaucuccaaccaaaaucugaaaauucugcagaucggguguaacgagaucggagacgugggcguucagcuccugugccgcgcucuuacccacacagauuguagacuggaaauucucgggcuggaggaaugcggacucaccagcacguguugcaaggaccuggccuccgugcuuaccuguucuaagacacugcaacagcugaaucucacccugaacacacuugaucauaccggcgucgugguucugugcgaggcucuccggcacccugagugugcccuucaggugcucgggcugagaaaaacggacuuugaugaagagacacaggcccuucugaccgcugaagaggaacgcaaucccaaccugacaaucaccgacgauugcgacaccauuacacgggucgagaucuga

SEQ ID NO: 9081 - protein, 1200 aa, Artificial Sequence
  NALP5__Homo_sapiens__P59047
MKVAGGLELGAAALLSASPRALVTLSTGPTCSILPKNPLFPQNLSSQPCIKMEGDKSLTFSSYGLQWCLYELDKEEFQTFKELLKKKSSESTTCSIPQFEIENANVECLALLLHEYYGASLAWATSISIFENMNLRTLSEKARDDMKRHSPEDPEATMTDQGPSKEKVPGISQAVQQDSATAAETKEQEISQAMEQEGATAAETEEQEISQAMEQEGATAAETEEQGHGGDTWDYKSHVMTKFAEEEDVRRSFENTAADWPEMQTLAGAFDSDRWGFRPRTVVLHGKSGIGKSALARRIVLCWAQGGLYQGMFSYVFFLPVREMQRKKESSVTEFISREWPDSQAPVTEIMSRPERLLFIIDGFDDLGSVLNNDTKLCKDWAEKQPPFTLIRSLLRKVLLPESFLIVTVRDVGTEKLKSEVVSPRYLLVRGISGEQRIHLLLERGIGEHQKTQGLRAIMNNRELLDQCQVPAVGSLICVALQLQDVVGESVAPFNQTLTGLHAAFVFHQLTPRGVVRRCLNLEERVVLKRFCRMAVEGVWNRKSVFDGDDLMVQGLGESELRALFHMNILLPDSHCEEYYTFFHLSLQDFCAALYYVLEGLEIEPALCPLYVEKTKRSMELKQAGFHIHSLWMKRFLFGLVSEDVRRPLEVLLGCPVPLGVKQKLLHWVSLLGQQPNATTPGDTLDAFHCLFETQDKEFVRLALNSFQEVWLPINQNLDLIASSFCLQHCPYLRKIRVDVKGIFPRDESAEACPVVPLWMRDKTLIEEQWEDFCSMLGTHPHLRQLDLGSSILTERAMKTLCAKLRHPTCKIQTLMFRNAQITPGVQHLWRIVMANRNLRSLNLGGTHLKEEDVRMACEALKHPKCLLESLRLDCCGLTHACYLKISQILTTSPSLKSLSLAGNKVTDQGVMPLSDALRVSQCALQKLILEDCGITATGCQSLASALVSNRSLTHLCLSNNSLGNEGVNLLCRSMRLPHCSLQRLMLNQCHLDTAGCGFLALALMGNSWLTHLSLSMNPVEDNGVKLLCEVMREPSCHLQDLELVKCHLTAACCESLSCVISRSRHLKSLDLTDNALGDGGVAALCEGLKQKNSVLARLGLKACGLTSDCCEALSLALSCNRHLTSLNLVQNNFSPKGMMKLCSAFACPTSNLQIIGLWKWQYPVQIRKLLEEVQLLKPRVVIDGSWHSFDEDDRYWWKN

SEQ ID NO: 9082 - RNA, 3603 nt, Artificial Sequence
  NALP5__Homo_sapiens__CCDS12938.1
augaagguugcaggaggacuugaacuuggagcugcugcucugcucucagcaucaccacgugcucuugucacucuuuccacagguccuacuugcucuauauuaccaaagaauccacuuuucccccaaaaccugagcucucagccuuguaucaagauggaaggagacaaaucgcucaccuuuuccagcuacgggcugcaauggugucucuaugagcuagacaaggaagaauuucagacauucaaggaauuacuaaagaagaaaucuucagaaucgaccacaugcucuauuccacaguuugaaaucgagaaugccaacguggaaugucuggcacuccucuugcaugaguauuauggagcaucgcuggccugggcuacguccauuagcaucuuugaaaacaugaaccugcgaacccucucggagaaggcacgggaugacaugaaaagacauucaccagaagauccugaagcaacgaugacugaccaaggaccaagcaaggaaaaagugccaggaauuucacaagcugugcaacaagauagugccacagcugcagagacaaaagaacaagaaauuucacaagcuauggaacaagaaggugccacagcagcagagacagaagaacaagaaauuucacaagcuauggaacaagaaggugccacagcagcagagacagaagaacaaggacauggaggugacacaugggacuacaagagucacgugaugaccaaauucgcugaggaggaggauguacgucguaguuuugaaaacacugcugcugacuggccggaaaugcaaacguuggcuggugcuuuugauucagaccgguggggcuuccggccucgcacggugguucugcacggaaagucaggaauugggaaaucggcucuagccagaaggaucgugcugugcugggcgcaagguggacucuaccagggaauguucuccuacgucuucuuccuccccguuagagagaugcagcggaagaaggagagcagugucacagaguucaucuccagggaguggccagacucccaggcuccggugacggagaucaugucccgaccagaaaggcuguuguucaucauugacgguuucgaugaccugggcucuguccucaacaaugacacaaagcucugcaaagacugggcugagaagcagccuccguucacccucauacgcagucugcugaggaagguccugcucccugaguccuuccugaucgucaccgucagagacgugggcacagagaagcucaagucagaggucgugucuccccguuaccuguuaguuagaggaaucuccggggaacaaagaauccacuugcuccuugagcgcgggauuggugagcaucagaagacacaaggguugcgugcgaucaugaacaaccgugagcugcucgaccagugccaggugcccgccgugggcucucucaucugcguggcccugcagcugcaggacguggugggggagagcgucgcccccuucaaccaaacgcucacaggccugcacgccgcuuuuguguuucaucagcucaccccucgaggcgugguccggcgcugucucaaucuggaggaaagaguuguccugaagcgcuucugccguauggcuguggagggaguguggaauaggaagucaguguuugacggugacgaccucaugguucaaggacucggggagucugagcuccgugcucuguuucacaugaacauccuucucccagacagccacugugaggaguacuacaccuucuuccaccucagucuccaggacuucugugccgccuuguacuacguguuagagggccuggaaaucgagccagcucucugcccucuguacguugagaagacaaagagguccauggagcuuaaacaggcaggcuuccauauccacucgcuuuggaugaagcguuucuuguuuggccucgugagcgaagacguaaggaggccacuggagguccugcugggcugucccguuccccugggggugaagcagaagcuucugcacugggucucucuguugggucagcagccuaaugccaccaccccaggagacacccuggacgccuuccacugucuuuucgagacucaagacaaagaguuuguucgcuuggcauuaaacagcuuccaagaaguguggcuuccgauuaaccagaaccuggacuugauagcaucuuccuucugccuccagcacuguccguauuugcggaaaauucggguggaugucaaagggaucuucccaagagaugaguccgcugaggcauguccuguggucccucuauggaugcgggauaagacccucauugaggagcagugggaagauuucugcuccaugcuuggcacccacccacaccugcggcagcuggaccugggcagcagcauccugacagagcgggccaugaagacccugugugccaagcugaggcaucccaccugcaagauacagacccugauguuuagaaaugcacagauuaccccuggugugcagcaccucuggagaaucgucauggccaaccguaaccuaagaucccucaacuugggaggcacccaccugaaggaagaggauguaaggauggcgugugaagccuuaaaacacccaaaauguuuguuggagucuuugaggcuggauugcuguggauugacccaugccuguuaccugaagaucucccaaauccuuacgaccucccccagccugaaaucucugagccuggcaggaaacaaggugacagaccagggaguaaugccucucagugaugccuugagagucucccagugcgcccugcagaagcugauacuggaggacuguggcaucacagccacggguugccagagucuggccucagcccucgucagcaaccggagcuugacacaccugugccuauccaacaacagccuggggaacgaagguguaaaucuacugugucgauccaugaggcuuccccacuguagucugcagaggcugaugcugaaucagugccaccuggacacggcuggcugugguuuucuugcacuugcgcuuauggguaacucauggcugacgcaccugagccuuagcaugaacccuguggaagacaauggcgugaagcuucugugcgaggucaugagagaaccaucuugucaucuccaggaccuggaguugguaaagugucaucucaccgccgcgugcugugagagucuguccugugugaucucgaggagcagacaccugaagagccuggaucucacggacaaugcccugggugacggugggguugcugcgcugugcgagggacugaagcaaaagaacaguguucuggcgagacucggguugaaggcauguggacugacuucugauugcugugaggcacucuccuuggcccuuuccugcaaccggcaucugaccagucuaaaccuggugcagaauaacuucagucccaaaggaaugaugaagcuguguucggccuuugccugucccacgucuaacuuacagauaauugggcuguggaaauggcaguacccugugcaaauaaggaagcugcuggaggaagugcagcuacucaagccccgagucguaauugacgguaguuggcauucuuuugaugaagaugaccgguacugguggaaaaacuga

SEQ ID NO: 9083 - RNA, 3603 nt, Artificial Sequence
  derived and/or modified sequence opt1 from NALP5__Homo_sapiens__CCDS12938.1
augaagguggccggcgggcuggagcucggcgccgcggcccugcugagcgccagcccccgcgcccucgucacccugagcaccgggccgacgugcuccauccugcccaagaacccccucuucccccagaaccugagcucccagccgugcaucaagauggagggcgacaagagccugaccuucuccagcuacgggcuccaguggugccuguacgagcuggacaaggaggaguuccagaccuucaaggagcuccugaagaagaaguccagcgaguccaccacgugcagcaucccccaguucgagaucgagaacgccaacguggagugccuggcgcuccugcugcacgaguacuacggcgccucccucgccugggccaccagcaucuccaucuucgagaacaugaaccugcggacccugagcgagaaggcgcgcgacgacaugaagcggcacucccccgaggaccccgaggccaccaugacggaccagggcccgagcaaggagaaggugcccgggaucucccaggccguccagcaggacagcgccaccgccgcggagaccaaggagcaggagaucagccaggccauggagcaggagggcgccaccgccgccgagacggaggagcaggagaucucccaggcgauggagcaggagggggccaccgccgccgagaccgaggagcagggccacgggggcgacaccugggacuacaagagccacgugaugacgaaguucgccgaggaggaggacgugcgccgguccuucgagaacaccgcggccgacuggcccgagaugcagacccucgccggcgccuucgacagcgaccgcuggggguuccggccccgcaccgucgugcugcacggcaaguccgggaucggcaagagcgcccuggcgcggcgcaucgugcucugcugggcccagggcgggcuguaccagggcauguucuccuacgucuucuuccugccggugcgggagaugcagcgcaagaaggagagcuccgugacggaguucaucagccgggaguggcccgacucccaggcccccgucaccgagaucaugagccgccccgagcggcuccuguucaucaucgacggguucgacgaccugggcuccgugcucaacaacgacaccaagcugugcaaggacugggccgagaagcagccgcccuucacccugauccgcagccuccugcggaaggugcugcuccccgaguccuuccugaucgucacggugcgcgacguggggaccgagaagcugaaguccgaggucgugagcccccgguaccuccuggugcgcggcaucagcggcgagcagcggauccaccuccugcuggagcgcgggaucggcgagcaccagaagacccaggggcugcgcgcgaucaugaacaaccgggagcuccuggaccagugccaggucccggccgugggcucccugaucugcguggcccuccagcugcaggacgucgugggggagagcgucgcccccuucaaccagacccugacgggccugcacgccgcguucguguuccaccagcucacgccccgcggcgugguccggcgcugccugaaccuggaggagcggguggugcucaagcgcuucugccggauggccgucgaggggguguggaaccgcaagagcguguucgacggcgacgaccugaugguccaggggcugggcgaguccgagcuccgggcccuguuccacaugaacauccugcuccccgacagccacugcgaggaguacuacaccuucuuccaccugucccugcaggacuucugcgccgcccucuacuacgugcuggaggggcuggagaucgagccggcgcucugcccccuguacguggagaagaccaagcgcagcauggagcugaagcaggccggcuuccacauccacucccucuggaugaagcgguuccuguucggccuggucagcgaggacgugcgccggccccucgaggugcugcuggggugccccgucccgcucggcgugaagcagaagcugcugcacugggugucccuccuggggcagcagcccaacgccaccacccccggcgacacccuggacgccuuccacugccucuucgagacccaggacaaggaguucguccgccuggcccugaacagcuuccaggagguguggcucccgaucaaccagaaccuggaccugaucgcguccagcuucugccuccagcacugccccuaccugcggaagauccgcguggacgucaagggcaucuucccccgggacgaguccgccgaggccugccccguggugccgcuguggaugcgcgacaagacgcucaucgaggagcagugggaggacuucugcagcaugcuggggacccacccccaccuccggcagcuggaccugggcuccagcauccugaccgagcgcgccaugaagacccucugcgcgaagcugcgccacccgaccugcaagauccagacgcugauguuccggaacgcccagaucacccccgggguccagcaccucuggcgcaucgugauggccaaccggaaccugcgcucccugaaccucggcgggacccaccugaaggaggaggacgugcggauggccugcgaggcccugaagcaccccaagugccuccuggagagccugcgccucgacugcugcggccugacccacgcgugcuaccugaagaucucccagauccucacgaccagccccagccugaagucccugagccucgccggcaacaaggucaccgaccagggggugaugccccuguccgacgcccugcgggugagccagugcgcccuccagaagcugauccuggaggacugcggcaucaccgccacggggugccagucccucgcgagcgcccuggucuccaaccgcagccugacccaccucugccuguccaacaacagccugggcaacgagggggugaaccuccugugccgguccaugcgccugccccacugcagccuccagcggcugaugcugaaccagugccaccucgacaccgccggcugcggcuuccuggcccuggcccucauggggaacuccuggcugacccaccugagccucuccaugaacccgguggaggacaacggcgucaagcugcugugcgaggugaugcgcgagcccagcugccaccuccaggaccuggagcuggugaagugccaccucacggcggccugcugcgagucccugagcugcgucaucucccggagccgccaccugaagucccuggaccucaccgacaacgcccugggggacggcgggguggccgcgcugugcgagggccucaagcagaagaacuccgugcuggcccggcugggccucaaggccugcgggcugaccagcgacugcugcgaggcccugucccucgcccugagcugcaaccgccaccugaccucccucaaccugguccagaacaacuucagccccaagggcaugaugaagcugugcuccgcguucgccugccccacgagcaaccuccagaucaucgggcuguggaaguggcaguacccggugcagauccggaagcugcucgaggaggugcagcugcugaagccccgcgucgugaucgacggcuccuggcacagcuucgacgaggacgaccgguacugguggaagaacuga

SEQ ID NO: 9084 - RNA, 3603 nt, Artificial Sequence
  derived and/or modified sequence opt2 from NALP5__Homo_sapiens__CCDS12938.1
augaaggucgccggcggccucgagcucggcgccgccgcccuccucuccgccuccccccgcgcccucgucacccucuccaccggccccaccugcuccauccuccccaagaacccccucuucccccagaaccucuccucccagcccugcaucaagauggagggcgacaagucccucaccuucuccuccuacggccuccaguggugccucuacgagcucgacaaggaggaguuccagaccuucaaggagcuccucaagaagaaguccuccgaguccaccaccugcuccaucccccaguucgagaucgagaacgccaacgucgagugccucgcccuccuccuccacgaguacuacggcgccucccucgccugggccaccuccaucuccaucuucgagaacaugaaccuccgcacccucuccgagaaggcccgcgacgacaugaagcgccacucccccgaggaccccgaggccaccaugaccgaccagggccccuccaaggagaagguccccggcaucucccaggccguccagcaggacuccgccaccgccgccgagaccaaggagcaggagaucucccaggccauggagcaggagggcgccaccgccgccgagaccgaggagcaggagaucucccaggccauggagcaggagggcgccaccgccgccgagaccgaggagcagggccacggcggcgacaccugggacuacaagucccacgucaugaccaaguucgccgaggaggaggacguccgccgcuccuucgagaacaccgccgccgacuggcccgagaugcagacccucgccggcgccuucgacuccgaccgcuggggcuuccgcccccgcaccgucguccuccacggcaaguccggcaucggcaaguccgcccucgcccgccgcaucguccucugcugggcccagggcggccucuaccagggcauguucuccuacgucuucuuccuccccguccgcgagaugcagcgcaagaaggaguccuccgucaccgaguucaucucccgcgaguggcccgacucccaggcccccgucaccgagaucaugucccgccccgagcgccuccucuucaucaucgacggcuucgacgaccucggcuccguccucaacaacgacaccaagcucugcaaggacugggccgagaagcagccccccuucacccucauccgcucccuccuccgcaagguccuccuccccgaguccuuccucaucgucaccguccgcgacgucggcaccgagaagcucaaguccgaggucgucuccccccgcuaccuccucguccgcggcaucuccggcgagcagcgcauccaccuccuccucgagcgcggcaucggcgagcaccagaagacccagggccuccgcgccaucaugaacaaccgcgagcuccucgaccagugccagguccccgccgucggcucccucaucugcgucgcccuccagcuccaggacgucgucggcgaguccgucgcccccuucaaccagacccucaccggccuccacgccgccuucgucuuccaccagcucaccccccgcggcgucguccgccgcugccucaaccucgaggagcgcgucguccucaagcgcuucugccgcauggccgucgagggcgucuggaaccgcaaguccgucuucgacggcgacgaccucaugguccagggccucggcgaguccgagcuccgcgcccucuuccacaugaacauccuccuccccgacucccacugcgaggaguacuacaccuucuuccaccucucccuccaggacuucugcgccgcccucuacuacguccucgagggccucgagaucgagcccgcccucugcccccucuacgucgagaagaccaagcgcuccauggagcucaagcaggccggcuuccacauccacucccucuggaugaagcgcuuccucuucggccucgucuccgaggacguccgccgcccccucgagguccuccucggcugccccgucccccucggcgucaagcagaagcuccuccacugggucucccuccucggccagcagcccaacgccaccacccccggcgacacccucgacgccuuccacugccucuucgagacccaggacaaggaguucguccgccucgcccucaacuccuuccaggaggucuggcuccccaucaaccagaaccucgaccucaucgccuccuccuucugccuccagcacugccccuaccuccgcaagauccgcgucgacgucaagggcaucuucccccgcgacgaguccgccgaggccugccccgucgucccccucuggaugcgcgacaagacccucaucgaggagcagugggaggacuucugcuccaugcucggcacccacccccaccuccgccagcucgaccucggcuccuccauccucaccgagcgcgccaugaagacccucugcgccaagcuccgccaccccaccugcaagauccagacccucauguuccgcaacgcccagaucacccccggcguccagcaccucuggcgcaucgucauggccaaccgcaaccuccgcucccucaaccucggcggcacccaccucaaggaggaggacguccgcauggccugcgaggcccucaagcaccccaagugccuccucgagucccuccgccucgacugcugcggccucacccacgccugcuaccucaagaucucccagauccucaccaccucccccucccucaagucccucucccucgccggcaacaaggucaccgaccagggcgucaugccccucuccgacgcccuccgcgucucccagugcgcccuccagaagcucauccucgaggacugcggcaucaccgccaccggcugccagucccucgccuccgcccucgucuccaaccgcucccucacccaccucugccucuccaacaacucccucggcaacgagggcgucaaccuccucugccgcuccaugcgccucccccacugcucccuccagcgccucaugcucaaccagugccaccucgacaccgccggcugcggcuuccucgcccucgcccucaugggcaacuccuggcucacccaccucucccucuccaugaaccccgucgaggacaacggcgucaagcuccucugcgaggucaugcgcgagcccuccugccaccuccaggaccucgagcucgucaagugccaccucaccgccgccugcugcgagucccucuccugcgucaucucccgcucccgccaccucaagucccucgaccucaccgacaacgcccucggcgacggcggcgucgccgcccucugcgagggccucaagcagaagaacuccguccucgcccgccucggccucaaggccugcggccucaccuccgacugcugcgaggcccucucccucgcccucuccugcaaccgccaccucaccucccucaaccucguccagaacaacuucucccccaagggcaugaugaagcucugcuccgccuucgccugccccaccuccaaccuccagaucaucggccucuggaaguggcaguaccccguccagauccgcaagcuccucgaggagguccagcuccucaagccccgcgucgucaucgacggcuccuggcacuccuucgacgaggacgaccgcuacugguggaagaacuga

SEQ ID NO: 9085 - RNA, 3603 nt, Artificial Sequence
  derived and/or modified sequence opt3 from NALP5__Homo_sapiens__CCDS12938.1
augaagguggccggcgggcuggagcucggagcugcagcccuucugagcgcgucccccagagcuuuggucaccuuaucuacagguccuacuugcucaauccugcccaaaaacccgcuauucccccagaaucucaguagccaaccuuguauuaagauggaaggcgacaaaucccugacguuuucuucguacgggcuucaguggugccuguaugaguuggauaaggaagaguuccagaccuuuaaagaacuccugaagaagaaaucaagcgagaguacaacuuguuccauaccacaguucgagaucgaaaacgccaauguugagugccuggcacucuuacugcacgaauacuauggagccucucuugcuugggcaaccagcauuuccaucuuugagaacaugaauuugaggacacugucagagaaggcccgggacgauaugaaacgccauagucccgaagacccugaggcuaccaugacugaucaaggcccaagcaaggaaaaagugcccgguauuucucaggccguacagcaggacuccgcgacagcagccgagaccaaggaacaagagaucucacaggcuauggagcaggaaggggccacggcagcugagacugaagaacaggaaauaagccaagccauggagcaggagggagcgaccgccgcagaaacagaggaacagggccacggcggggauacuugggacuacaagagucaugugaugaccaaauucgcugaggaagaggauguccgacguucuuuugagaacacagccgcugacuggccugaaaugcaaacccuagccggagcauucgauuccgacagaugggguuuuaggccacggacggugguucuccacggcaagagcgggaucggaaaaucggcccuggcucgcagaauugugcuuuguugggcgcagggcggucuguaucaggggauguucucuuacgucuuuuucuugccggugagggagaugcagcggaagaaagaauccucaguaacugaguuuaucagucgcgaguggcccgauagccaagcaccuguuacagaaauuaugucccgaccagagagacuccuguucaucauagacggauucgacgauuuaggcucugugcugaauaacgacaccaagcucugcaaagauugggccgaaaagcagcccccuuuuacucuuauuaggagccuguugcggaagguccuacugccagagucauuccucaucgugacagugcgugacgucggcaccgaaaaacugaagagugagguuguguccccacgcuaucuucugguaagagggauuagcggagagcagaggauccauuugcuccuggaacgggguaucggcgagcaccagaaaacgcaaggguuacgagcuauuaugaauaaccgcgaacugcuagaucagugucaggugccggccgucggaucucucauaugcguggcacugcagcuucaagacguugugggcgagucagucgccccuuuuaaucagaccuugacaggucugcacgcugccuucguguuucaucagcucacucccagagggguaguuaggcggugucugaaccuugaagaacgcgugguccugaagagauucugcaggauggcaguggagggcgucuggaaucguaaaaguguguuugauggagacgauuugaugguucagggccucggggaaagcgagcugcgggcguuauuccacaugaacauccugcuaccagacucccauugugaagaguacuacaccuuuuuccaccucucucugcaagauuuuugcgcugcccuuuauuacguguuggaaggacuggagauugagccugcacucugcccccuguauguagaaaagacaaagcgaucgauggaguuaaaacaggccgguuuccacauccauagccuguggaugaagagauuucuuuucggcuuggucuccgaagacgugaggcgcccacucgagguucugcuagggugucccgugccucugggagucaaacagaagcuccugcacugggugucacuuuugggccaacagccaaaugcuacuaccccgggugacacacuggaugccuuccauugcuuauuugagacccaggacaaagaguucguacggcucgcacugaacaguuuucaggagguguggcuucccauaaaccaaaaucuggauuugauugcuucuagcuucugucuccagcacugcccuuaccugagaaagaucaggguugacgucaaggggaucuuuccacgcgaugaauccgccgaggcgugucccguggugccucuauggaugcgagacaaaacucugauugaggagcagugggaggauuucugcucaaugcucggcacgcauccacaucugcggcagcuugacuugggaagcucuauccugacagaacgugccaugaagaccuuaugugcuaaacucagacaccccacuugcaagauucaaacccugauguuuaggaacgcacagauaacaccgggcguccagcaccuuuggcgcaucguuauggccaaucggaaccugagaucccuaaaucucgggggaacccaccugaaagaggaagaugugaggauggcuugugaggccuugaagcauccuaagugccuguuagaaagucuccgacuggacuguugcggucuuacucacgcaugcuaucugaaaauuagccagaucuugacaacgucuccaucccucaagucacugagucuagcgggcaacaaagugaccgaucaagggguaaugccccugagcgacgcccuucgcgucucgcagugugcucuccagaagcugaucuuggaggauugcggaauuacugccacaggcugucaaucccuggcaucugcuuuagugagcaaucggucacucacccaccugugccuuaguaacaauucccuggguaacgaggggguuaauuugcucuguagaucuaugaggcugccucauugcagccuacagcgucugaugcuuaaccagugucaccucgacacagccggcugcggauuccuggcauuggccuuaaugggcaauuccuggcugacucaucucucacugagcaugaaccccguggaagacaauggggucaaacuucugugugaggugaugcgcgaaccaaguugccacuugcaggaucuagagcugguuaagugucaucucaccgcugcgugcugcgaaucucuguccugugugauaagccggucgagacaccuuaaaucauuagaccugacggauaacgcccucggagacggcgguguagcagcuuugugcgaggggcugaagcaaaagaacucuguccucgccaggcugggacuuaaagccuguggccugaccagugauugcugugaggcuuugucccuagcacugagcugcaaucgacaccucacaucuuuaaaccuggugcagaauaacuuuagcccuaaggguaugaugaaacuuuguuccgccuucgcgugccccacuucaaaucugcagaucauuggccucuggaaguggcaguacccagugcaaauccggaaauugcuggaagagguccagcuccugaagccgcgcguugugauugacgggaguuggcauagcuuugaugaagacgauagauauugguggaagaacuga

SEQ ID NO: 9086 - RNA, 3603 nt, Artificial Sequence
  derived and/or modified sequence opt4 from NALP5__Homo_sapiens__CCDS12938.1
augaagguggccggcggccuggagcugggcgccgccgcccugcugagcgccagccccagagcccuggugacccugagcaccggccccaccugcagcauccugcccaagaacccccuguucccccagaaccugagcagccagcccugcaucaagauggagggcgacaagagccugaccuucagcagcuacggccugcaguggugccuguacgagcuggacaaggaggaguuccagaccuucaaggagcugcugaagaagaagagcagcgagagcaccaccugcagcaucccccaguucgagaucgagaacgccaacguggagugccuggcccugcugcugcacgaguacuacggcgccagccuggccugggccaccagcaucagcaucuucgagaacaugaaccugagaacccugagcgagaaggccagagacgacaugaagagacacagccccgaggaccccgaggccaccaugaccgaccagggccccagcaaggagaaggugcccggcaucagccaggccgugcagcaggacagcgccaccgccgccgagaccaaggagcaggagaucagccaggccauggagcaggagggcgccaccgccgccgagaccgaggagcaggagaucagccaggccauggagcaggagggcgccaccgccgccgagaccgaggagcagggccacggcggcgacaccugggacuacaagagccacgugaugaccaaguucgccgaggaggaggacgugagaagaagcuucgagaacaccgccgccgacuggcccgagaugcagacccuggccggcgccuucgacagcgacagauggggcuucagacccagaaccguggugcugcacggcaagagcggcaucggcaagagcgcccuggccagaagaaucgugcugugcugggcccagggcggccuguaccagggcauguucagcuacguguucuuccugcccgugagagagaugcagagaaagaaggagagcagcgugaccgaguucaucagcagagaguggcccgacagccaggcccccgugaccgagaucaugagcagacccgagagacugcuguucaucaucgacggcuucgacgaccugggcagcgugcugaacaacgacaccaagcugugcaaggacugggccgagaagcagccccccuucacccugaucagaagccugcugagaaaggugcugcugcccgagagcuuccugaucgugaccgugagagacgugggcaccgagaagcugaagagcgagguggugagccccagauaccugcuggugagaggcaucagcggcgagcagagaauccaccugcugcuggagagaggcaucggcgagcaccagaagacccagggccugagagccaucaugaacaacagagagcugcuggaccagugccaggugcccgccgugggcagccugaucugcguggcccugcagcugcaggacguggugggcgagagcguggcccccuucaaccagacccugaccggccugcacgccgccuucguguuccaccagcugacccccagaggcguggugagaagaugccugaaccuggaggagagaguggugcugaagagauucugcagaauggccguggagggcguguggaacagaaagagcguguucgacggcgacgaccugauggugcagggccugggcgagagcgagcugagagcccuguuccacaugaacauccugcugcccgacagccacugcgaggaguacuacaccuucuuccaccugagccugcaggacuucugcgccgcccuguacuacgugcuggagggccuggagaucgagcccgcccugugcccccuguacguggagaagaccaagagaagcauggagcugaagcaggccggcuuccacauccacagccuguggaugaagagauuccuguucggccuggugagcgaggacgugagaagaccccuggaggugcugcugggcugccccgugccccugggcgugaagcagaagcugcugcacugggugagccugcugggccagcagcccaacgccaccacccccggcgacacccuggacgccuuccacugccuguucgagacccaggacaaggaguucgugagacuggcccugaacagcuuccaggagguguggcugcccaucaaccagaaccuggaccugaucgccagcagcuucugccugcagcacugccccuaccugagaaagaucagaguggacgugaagggcaucuuccccagagacgagagcgccgaggccugccccguggugccccuguggaugagagacaagacccugaucgaggagcagugggaggacuucugcagcaugcugggcacccacccccaccugagacagcuggaccugggcagcagcauccugaccgagagagccaugaagacccugugcgccaagcugagacaccccaccugcaagauccagacccugauguucagaaacgcccagaucacccccggcgugcagcaccuguggagaaucgugauggccaacagaaaccugagaagccugaaccugggcggcacccaccugaaggaggaggacgugagaauggccugcgaggcccugaagcaccccaagugccugcuggagagccugagacuggacugcugcggccugacccacgccugcuaccugaagaucagccagauccugaccaccagccccagccugaagagccugagccuggccggcaacaaggugaccgaccagggcgugaugccccugagcgacgcccugagagugagccagugcgcccugcagaagcugauccuggaggacugcggcaucaccgccaccggcugccagagccuggccagcgcccuggugagcaacagaagccugacccaccugugccugagcaacaacagccugggcaacgagggcgugaaccugcugugcagaagcaugagacugccccacugcagccugcagagacugaugcugaaccagugccaccuggacaccgccggcugcggcuuccuggcccuggcccugaugggcaacagcuggcugacccaccugagccugagcaugaaccccguggaggacaacggcgugaagcugcugugcgaggugaugagagagcccagcugccaccugcaggaccuggagcuggugaagugccaccugaccgccgccugcugcgagagccugagcugcgugaucagcagaagcagacaccugaagagccuggaccugaccgacaacgcccugggcgacggcggcguggccgcccugugcgagggccugaagcagaagaacagcgugcuggccagacugggccugaaggccugcggccugaccagcgacugcugcgaggcccugagccuggcccugagcugcaacagacaccugaccagccugaaccuggugcagaacaacuucagccccaagggcaugaugaagcugugcagcgccuucgccugccccaccagcaaccugcagaucaucggccuguggaaguggcaguaccccgugcagaucagaaagcugcuggaggaggugcagcugcugaagcccagaguggugaucgacggcagcuggcacagcuucgacgaggacgacagauacugguggaagaacuga

SEQ ID NO: 9087 - RNA, 3603 nt, Artificial Sequence
  derived and/or modified sequence opt5 from NALP5__Homo_sapiens__CCDS12938.1
augaagguggccggcgggcuggagcucggagcugccgcgcugcuuagcgcuucccccagagcccuggucacccucucuacaggcccuacgugcagcauccugccgaaaaacccccuuuucccucagaaucuguccucucaacccuguauuaagauggaaggggacaaaagccucaccuuuuccucuuacggacugcaguggugccuguaugagcucgauaaggaagaguuccagacauuuaaagaacugcuuaagaagaaaagcuccgagagcaccacauguucuaucccucaguucgagauugaaaacgccaauguugagugccuggcucuccugcuucacgaauacuauggcgccucccuggcuugggccaccagcaucucuauuuuugagaacaugaaucuccggacacuguccgagaaggcgcgcgacgauaugaaaagacauagccccgaagacccugaggccaccaugacggaucaagggccgucuaaggaaaaagugcccggaaucucccaggcugugcagcaggacagcgccaccgcugccgagacaaaggaacaagagaucucccaggcgauggagcaggaaggcgccaccgcugccgagacagaagaacaggaaauuucucaagcuauggagcaggagggcgccaccgccgcugaaacggaggaacaggggcacggaggcgauacaugggacuacaagagccaugucaugaccaaauucgcggaggaagaggaugugcggcgcuccuuugagaacacagccgcugacuggccugaaaugcaaacccuggccggggccuucgauagcgacagauggggauuucggccccgcaccguugugcuccacggcaagucugggaucggaaaauccgcucuggccagacggauuguccuuuguugggcgcagggcggccuguaucaggggauguucagcuacguguuuuuccucccuguucgcgagaugcagagaaagaaagaaucuagcgugacagaguuuaucucccgggaguggcccgauucucaagcuccggucacggaaauuaugagccgcccugagagacugcuuuucaucauugacggauucgacgaucugggcuccgugcucaauaacgacaccaagcugugcaaagauugggccgaaaagcagcccccuuuuacacugauccggagccuccugcgcaaggugcuucugcccgagucuuuccucaucgucaccguuagagacguggggacagaaaaacugaaguccgagguggucagcccccgguaucuucuggugagaggaauuucuggcgagcagcgcauccaucuccugcuggaacgggggauuggagagcaccagaaaacccaaggccucagagccaucaugaauaaccgcgaacugcuugaucagugucagguuccugcugugggcucccugauuugcgucgcccuccagcugcaagacgugguuggggagagcguggcuccguuuaaucagacgcugacaggacuucacgccgcguucgucuuucaucagcucacaccccggggcguggucagacgcugucugaaccuggaagaacgggugguucucaagagauucugccgcauggccguggagggggucuggaaucggaaauccguguuugauggagacgaucugaugguucagggccuuggggaaucugagcugagagcucucuuccacaugaacauccugcugccugacagccauugugaagaguacuacaccuuuuuccaccuuucccuccaagauuuuugcgccgcucuguauuacgugcuggaaggccucgagaucgagcccgcccugugcccucuuuaugucgaaaagaccaagcgcucuauggagcugaaacaggcgggauuccacauucauagccucuggaugaagcgguuucuguucggccugguguccgaagacgugagacggccccuugagguucuccugggguguccggucccucugggagugaaacagaagcuccugcacugggugagccuucugggccaacagcccaaugccaccacaccuggggacacgcucgaugcuuuccauugccuguuugagacccaggacaaagaguucguccgccuggcccuuaacucuuuucaggagguguggcuccccaucaaccaaaaucuggaucugauugcuuccagcuucugucuccagcacugcccuuaccugagaaagauccggguugacgugaagggaauuuuucccagagaugaaucugccgaggccuguccggucgugccucuuuggaugcgcgacaaaacacugaucgaggagcagugggaggauuucugcuccaugcucggcacccauccccaucugcggcagcuggaccuugggagcucuauccugacagaaagagcuaugaagacccucugugcgaaacugcgccaccccacgugcaagauucaaacccucauguuuagaaacgcccagaucacaccuggcguucagcaccuguggcggauugugauggcuaaucgcaaccuuagaagccugaaucucggaggcacccaccugaaagaggaagauguccggauggccugugaggcccugaagcauccgaagugccuucuggaaucccuccgccuggacuguugcgggcucacacacgcuugcuaucugaaaaucagccagauucuuaccacgucucccucccucaagagccugucccuggccggaaacaaagugacagaucaaggcguuaugccucugucugacgcgcuuagagugagccagugugcucugcagaagcucauccuggaggauugcgggauuaccgccacaggaugucaaucccucgccucugcucuggucagcaaucggucccuuacccaccugugccugucuaacaauagccucggcaacgagggggugaaucugcuuugucgcuccaugagacugccccauugcagccuccagcggcugaugcucaaccagugucaccuggacaccgccggcugcggauuccuugcgcuggcucugaugggcaauucuuggcucacacaucugucccuuagcaugaacccuguggaagacaauggggucaaacugcucugugagguuaugcgcgaacccucuugccaucugcaggaucucgagcuggugaagugucaccuuacggccgccugcugcgaaucccugagcugugugaucucuagaucccggcaccugaaaagccucgaccugaccgauaacgcucuuggagacggcggggucgccgcucugugcgagggacucaagcaaaagaacuccgugcuggccagacucggccugaaagcgugugggcuuacaagcgauugcugugaggcccugucucuggcucucagcugcaaucgccaccugaccucccuuaaccugguucagaauaacuuuucuccuaagggcaugaugaaacucuguagcgccuucgcuugccccacauccaaucugcagaucauuggacuguggaaguggcaguacccggugcaaauccggaaacuccuugaagagguccagcugcugaagccuagagugguuauugacggcucuuggcauagcuuugaugaagacgaucgcuauugguggaagaacuga

SEQ ID NO: 9088 - protein, 892 aa, Artificial Sequence
  NALP6__Homo_sapiens__P59044
MDQPEAPCSSTGPRLAVARELLLAALEELSQEQLKRFRHKLRDVGPDGRSIPWGRLERADAVDLAEQLAQFYGPEPALEVARKTLKRADARDVAAQLQERRLQRLGLGSGTLLSVSEYKKKYREHVLQLHARVKERNARSVKITKRFTKLLIAPESAAPEEAMGPAEEPEPGRARRSDTHTFNRLFRRDEEGRRPLTVVLQGPAGIGKTMAAKKILYDWAAGKLYQGQVDFAFFMPCGELLERPGTRSLADLILDQCPDRGAPVPQMLAQPQRLLFILDGADELPALGGPEAAPCTDPFEAASGARVLGGLLSKALLPTALLLVTTRAAAPGRLQGRLCSPQCAEVRGFSDKDKKKYFYKYFRDERRAERAYRFVKENETLFALCFVPFVCWIVCTVLRQQLELGRDLSRTSKTTTSVYLLFITSVLSSAPVADGPRLQGDLRNLCRLAREGVLGRRAQFAEKELEQLELRGSKVQTLFLSKKELPGVLETEVTYQFIDQSFQEFLAALSYLLEDGGVPRTAAGGVGTLLRGDAQPHSHLVLTTRFLFGLLSAERMRDIERHFGCMVSERVKQEALRWVQGQGQGCPGVAPEVTEGAKGLEDTEEPEEEEEGEEPNYPLELLYCLYETQEDAFVRQALCRFPELALQRVRFCRMDVAVLSYCVRCCPAGQALRLISCRLVAAQEKKKKSLGKRLQASLGGGSSSQGTTKQLPASLLHPLFQAMTDPLCHLSSLTLSHCKLPDAVCRDLSEALRAAPALTELGLLHNRLSEAGLRMLSEGLAWPQCRVQTVRVQLPDPQRGLQYLVGMLRQSPALTTLDLSGCQLPAPMVTYLCAVLQHQGCGLQTLSLASVELSEQSLQELQAVKRAKPDLVITHPALDGHPQPPKELISTF

SEQ ID NO: 9089 - RNA, 2679 nt, Artificial Sequence
  NALP6__Homo_sapiens__CCDS7693.1
auggaccagccagaggcccccugcuccagcacggggccgcgccucgcgguggcccgcgagcugcuccuggcugcgcuggaggaacugagccaagagcagcugaagcgcuuccgccacaagcugcgcgacgugggcccggacggacgcagcaucccgugggggcggcuggagcgcgcggacgccguggaccucgcggagcagcuggcccaguucuacggcccggagccugcccuggagguggcccgcaagacccucaagagggcggacgcgcgcgacguggcggcgcagcuccaggagcggcggcugcagcggcucgggcucggcuccgggacgcugcucuccguguccgaguacaagaagaaguaccgggagcacgugcugcagcugcacgcucgggugaaggagaggaacgcccgcuccgugaagaucaccaagcgcuucaccaagcugcucaucgcgcccgagagcgccgccccggaggaggcgauggggcccgcggaagagccugagccggggcgcgcgcggcgcucggacacgcacacuuucaaccgccucuuccgccgcgacgaggagggccggcggccgcugaccguggugcugcagggcccggcgggcaucggcaagaccauggcggccaaaaagauccuguacgacugggcggcgggcaagcuguaccagggccagguggacuucgccuucuucaugcccugcggcgagcugcuggagaggccgggcacgcgcagccuggcugaccugauccuggaccagugccccgaccgcggcgcgccggugccgcagaugcuggcccagccgcagcggcugcucuucauccuggacggcgcggacgagcugccggcgcuggggggccccgaggccgcgcccugcacagaccccuucgaggcggcgagcggcgcgcgggugcuaggcgggcugcugagcaaggcgcugcugcccacggcccuccugcuggugaccacgcgcgccgccgcccccgggaggcugcagggccgccuguguuccccgcagugcgccgaggugcgcggcuucuccgacaaggacaagaagaaguauuucuacaaguauuuccgggaugagaggagggccgagcgcgccuaccgcuucgugaaggagaacgagacgcuguucgcgcugugcuucgugcccuucgugugcuggaucgugugcaccgugcugcgccagcagcuggagcucggucgggaccugucgcgcacguccaagaccaccacgucaguguaccugcuuuucaucaccagcguucugagcucggcuccgguagccgacgggccccgguugcagggcgaccugcgcaaucugugccgccuggcccgcgagggcguccucggacgcagggcgcaguuugccgagaaggaacuggagcaacuggagcuucguggcuccaaagugcagacgcuguuucucagcaaaaaggagcugccgggcgugcuggagacagaggucaccuaccaguucaucgaccagagcuuccaggaguuccucgcggcacuguccuaccugcuggaggacggcggggugcccaggaccgcggcuggcggcguugggacacuccugcguggggacgcccagccgcacagccacuuggugcucaccacgcgcuuccucuucggacugcugagcgcggagcggaugcgcgacaucgagcgccacuucggcugcaugguuucagagcgugugaagcaggaggcccugcggugggugcagggacagggacagggcugccccggaguggcaccagaggugaccgagggggccaaagggcucgaggacaccgaagagccagaggaggaggaggagggagaggagcccaacuacccacuggaguugcuguacugccuguacgagacgcaggaggacgcguuugugcgccaagcccugugccgguucccggagcuggcgcugcagcgagugcgcuucugccgcauggacguggcuguucugagcuacugcgugaggugcugcccugcuggacaggcacugcggcugaucagcugcagauugguugcugcgcaggagaagaagaagaagagccuggggaagcggcuccaggccagccuggguggcggcagcaguucucaaggcaccacaaaacaacugccagccucccuucuucauccacucuuucaggcaaugacugacccacugugccaucugagcagccucacgcugucccacugcaaacucccugacgcggucugccgagaccuuucugaggcccugagggcagcccccgcacugacggagcugggccuccuccacaacaggcucagugaggcgggacugcguaugcugagugagggccuagccuggccgcagugcagggugcagacggucaggguacagcugccugacccccagcgagggcuccaguaccugguggguaugcuucggcagagcccugcccugaccacccuggaucucagcggcugccaacugcccgcccccauggugaccuaccugugugcaguccugcagcaccagggaugcggccugcagacccucagucuggccucuguggagcugagcgagcagucacuacaggagcuucaggcugugaagagagcaaagccggaucuggucaucacacacccagcgcuggacggccacccacaaccucccaaggaacucaucucgaccuucuga

SEQ ID NO: 9090 - RNA, 2679 nt, Artificial Sequence
  derived and/or modified sequence opt1 from NALP6__Homo_sapiens__CCDS7693.1
auggaccagcccgaggcccccugcagcuccaccggcccccgccuggccguggcgcgggagcuccugcuggccgcccucgaggagcugagccaggagcagcugaagcgcuuccggcacaagcuccgcgacgucgggcccgacggccgguccauccccugggggcgccuggagcgggccgacgccguggaccuggcggagcagcucgcccaguucuacggcccggagcccgcccuggagguggcccgcaagacccugaagcgggcggacgcccgcgacgucgccgcccagcuccaggagcggcgccugcagcggcuggggcucggcagcggcacgcugcuguccgugagcgaguacaagaagaaguaccgcgagcacgugcuccagcugcacgcccgggucaaggagcgcaacgcgcgguccgugaagaucaccaagcgcuucaccaagcugcucaucgcccccgagagcgccgcccccgaggaggccauggggccggcggaggagcccgagcccggccgggcccgccgguccgacacccacacguucaaccgccuguuccgccgggacgaggaggggcgccggccccugaccgugguccuccagggcccggccgggaucggcaagaccauggccgccaagaagauccuguacgacugggcggccggcaagcuguaccagggccagguggacuucgccuucuucaugcccugcggggagcuccuggagcgccccgggacccggagccuggccgaccucauccuggaccagugccccgaccgcggcgccccggugccccagaugcuggcgcagccccagcggcuccuguucauccuggacggcgccgacgagcuccccgcccucgggggcccggaggccgcgcccugcacggaccccuucgaggccgccuccggggcccgcguccugggcgggcuccugagcaaggcccugcuccccaccgcgcugcugcucgugaccacccgggccgccgccccgggccgccugcagggccggcugugcagcccccagugcgccgaggugcgcggguucuccgacaaggacaagaagaaguacuucuacaaguacuuccgggacgagcgccgggcggagcgcgccuaccgguucgucaaggagaacgagacgcuguucgcccugugcuucgugcccuucgugugcuggaucgucugcaccgugcugcgccagcagcuggagcucggccgggaccugucccgcaccagcaagaccacgaccuccguguaccuccuguucaucaccagcguccuguccagcgcccccguggccgacgggccgcgccugcagggcgaccuccggaaccugugccgccuggcgcgggagggggugcucggccgccgggcccaguucgccgagaaggagcuggagcagcuggagcuccgcggcagcaagguccagacccuguuccuguccaagaaggagcuccccggggugcuggagacggaggucaccuaccaguucaucgaccagagcuuccaggaguuccuggccgcgcucuccuaccugcuggaggacggcggggugccccggaccgccgccggcggggugggcacccuccugcgcggcgacgcccagccgcacagccaccugguccucacgacccgguuccuguucgggcugcucuccgccgagcgcaugcgggacaucgagcgccacuucggcugcauggugagcgagcgggugaagcaggaggcgcugcgcuggguccaggggcagggccagggcugccccgggguggcccccgaggugaccgagggcgccaaggggcuggaggacaccgaggagcccgaggaggaggaggagggcgaggagccgaacuacccccucgagcugcuguacugccucuacgagacgcaggaggacgccuucguccggcaggcccugugccgcuuccccgagcuggcgcuccagcgggugcgcuucugccggauggacguggccguccuguccuacugcgugcgcugcugccccgccgggcaggcccugcggcucaucagcugccgccugguggccgcgcaggagaagaagaagaagucccugggcaagcgccuccaggccagccugggcgggggcuccagcucccaggggaccaccaagcagcugccggccagccuccugcacccccuguuccaggccaugaccgacccccucugccaccuguccagccugacgcucucccacugcaagcugcccgacgcggucugccgggaccugagcgaggcccuccgcgccgccccggcccugaccgagcugggccuccugcacaaccggcuguccgaggcggggcuccgcaugcugagcgagggccuggccuggccccagugccgggugcagaccgugcgcguccagcuccccgacccccagcggggccugcaguaccugguggggaugcuccgccagagcccggcccugaccacgcuggaccucuccggcugccagcugcccgcccccauggugaccuaccugugcgccguccuccagcaccaggggugcggccugcagacccugagccucgcguccguggagcugagcgagcagucccugcaggagcuccaggccgugaagcgggccaagcccgaccuggucaucacccacccggcccuggacgggcacccccagccgcccaaggagcucaucagcaccuucuga

SEQ ID NO: 9091 - RNA, 2679 nt, Artificial Sequence
  derived and/or modified sequence opt2 from NALP6__Homo_sapiens__CCDS7693.1
auggaccagcccgaggcccccugcuccuccaccggcccccgccucgccgucgcccgcgagcuccuccucgccgcccucgaggagcucucccaggagcagcucaagcgcuuccgccacaagcuccgcgacgucggccccgacggccgcuccauccccuggggccgccucgagcgcgccgacgccgucgaccucgccgagcagcucgcccaguucuacggccccgagcccgcccucgaggucgcccgcaagacccucaagcgcgccgacgcccgcgacgucgccgcccagcuccaggagcgccgccuccagcgccucggccucggcuccggcacccuccucuccgucuccgaguacaagaagaaguaccgcgagcacguccuccagcuccacgcccgcgucaaggagcgcaacgcccgcuccgucaagaucaccaagcgcuucaccaagcuccucaucgcccccgaguccgccgcccccgaggaggccaugggccccgccgaggagcccgagcccggccgcgcccgccgcuccgacacccacaccuucaaccgccucuuccgccgcgacgaggagggccgccgcccccucaccgucguccuccagggccccgccggcaucggcaagaccauggccgccaagaagauccucuacgacugggccgccggcaagcucuaccagggccaggucgacuucgccuucuucaugcccugcggcgagcuccucgagcgccccggcacccgcucccucgccgaccucauccucgaccagugccccgaccgcggcgcccccgucccccagaugcucgcccagccccagcgccuccucuucauccucgacggcgccgacgagcuccccgcccucggcggccccgaggccgcccccugcaccgaccccuucgaggccgccuccggcgcccgcguccucggcggccuccucuccaaggcccuccuccccaccgcccuccuccucgucaccacccgcgccgccgcccccggccgccuccagggccgccucugcuccccccagugcgccgagguccgcggcuucuccgacaaggacaagaagaaguacuucuacaaguacuuccgcgacgagcgccgcgccgagcgcgccuaccgcuucgucaaggagaacgagacccucuucgcccucugcuucguccccuucgucugcuggaucgucugcaccguccuccgccagcagcucgagcucggccgcgaccucucccgcaccuccaagaccaccaccuccgucuaccuccucuucaucaccuccguccucuccuccgcccccgucgccgacggcccccgccuccagggcgaccuccgcaaccucugccgccucgcccgcgagggcguccucggccgccgcgcccaguucgccgagaaggagcucgagcagcucgagcuccgcggcuccaagguccagacccucuuccucuccaagaaggagcuccccggcguccucgagaccgaggucaccuaccaguucaucgaccaguccuuccaggaguuccucgccgcccucuccuaccuccucgaggacggcggcgucccccgcaccgccgccggcggcgucggcacccuccuccgcggcgacgcccagccccacucccaccucguccucaccacccgcuuccucuucggccuccucuccgccgagcgcaugcgcgacaucgagcgccacuucggcugcauggucuccgagcgcgucaagcaggaggcccuccgcuggguccagggccagggccagggcugccccggcgucgcccccgaggucaccgagggcgccaagggccucgaggacaccgaggagcccgaggaggaggaggagggcgaggagcccaacuacccccucgagcuccucuacugccucuacgagacccaggaggacgccuucguccgccaggcccucugccgcuuccccgagcucgcccuccagcgcguccgcuucugccgcauggacgucgccguccucuccuacugcguccgcugcugccccgccggccaggcccuccgccucaucuccugccgccucgucgccgcccaggagaagaagaagaagucccucggcaagcgccuccaggccucccucggcggcggcuccuccucccagggcaccaccaagcagcuccccgccucccuccuccacccccucuuccaggccaugaccgacccccucugccaccucuccucccucacccucucccacugcaagcuccccgacgccgucugccgcgaccucuccgaggcccuccgcgccgcccccgcccucaccgagcucggccuccuccacaaccgccucuccgaggccggccuccgcaugcucuccgagggccucgccuggccccagugccgcguccagaccguccgcguccagcuccccgacccccagcgcggccuccaguaccucgucggcaugcuccgccagucccccgcccucaccacccucgaccucuccggcugccagcuccccgcccccauggucaccuaccucugcgccguccuccagcaccagggcugcggccuccagacccucucccucgccuccgucgagcucuccgagcagucccuccaggagcuccaggccgucaagcgcgccaagcccgaccucgucaucacccaccccgcccucgacggccacccccagccccccaaggagcucaucuccaccuucuga

SEQ ID NO: 9092 - RNA, 2679 nt, Artificial Sequence
  derived and/or modified sequence opt3 from NALP6__Homo_sapiens__CCDS7693.1
auggaccagcccgaggccccuugcagcuccaccggcccaagacuggcuguggcaagggaacuccuucuggccgcguuggaggaauuaucucaagagcagcugaagcgguuccgccacaaacuacgagaugucgggccggacggacguucaauccccugggguagacucgaaagggcugaugccguugaccuggcagagcagcuugcccaguuuuacggcccugagccagcucuggaaguggcacggaagacauugaaacgcgccgaugcuagagacguagccgcgcaacuccaggagaggcggcugcagcgccuggggcucggaaguggcacuuuacugagcguguccgaauauaagaaaaaguaccgagagcauguccuucaguugcacgcaagagugaaggagaggaacgcccggucuguuaaaauuacgaagcguuucaccaaacugcuaauagcucccgaaucggccgcaccugaggaagcuauggguccagccgaggaacccgagccugggcgcgcgagaaggucagauacacauacuuuuaaucgguuguuccgacgcgacgaggaaggaagaaggccacugaccgugguccuucaaggcccggccggcaucgggaagacaauggcagcuaaaaagauucuguaugauugggccgcuggaaaguuguaccagggucagguggacuuugccuucuuuaugcccuguggcgagcuccuggaacggccugggacccgcagcuuagcagaucugauccucgaccagugcccagauagaggagcccccguaccucaaaugcuugcucagccacagaggcuguuguucauucuagacggcgcggacgagcugcccgcacucggugggccggaagccgcuccuuguacugaucccuuugaggccgcaaguggagcccguguucugggcggccuucuguccaaagcucuccucccaacagcccuguuacuggugaccacgcgggcagcggcuccugggcgacuacaaggaagacucugcucuccccagugugccgaggucagggguuucagcgacaaggauaaaaagaaauauuuuuacaaguauuuccgcgacgaacggagagcagagagggccuaccgcuuugugaaagaaaacgagacucuguucgcucuuugcuucgugccauuugucuguuggaucguuugcaccguguugcgacagcagcuggaacucggccgggaucugucccguacaucaaagacuaccacaaguguauaccuucuguucauaaccagcguguugucuuccgcccccgucgcagacgggccuagacuccaaggagaucugaggaauuuaugucgccuggcucgggagggcgugcuagguagaagggcccaguuugcggagaaggaacucgagcagcuggaacuucgagggucaaaaguucagacguuguuccugagcaagaaagagcucccaggcgugcuggagacugaagucacauaucaauuuaucgaccagaguuuccaggaguuuuuagccgcucugucuuaccuuuuggaagauggaggcgugccgcgcaccgcagccgggggaguagguacucuccugcggggcgacgcucagccccacucccaucuaguucugacaaccagauuccucuuugggcugcuuagcgccgagaggaugcgugauauugaacgccacuucggaugcauggugucggagcgggucaagcaagaggcauugagaugggugcagggccagggucagggguguccuggcgucgcgccagaagugacggagggagccaaaggccuggaagacaccgaggaacccgaggaggaagaggaaggggaggaaccuaacuauccauuagagcuccuguacugccuuuaugagacacaagaagacgcuuuuguuaggcaggcccugugccgauuccccgaguuggcacuccagcgggugcgcuuuuguagaauggauguagcuguccugucuuacugcgugagguguugcccggccggacaagcacuacggcugaucuccugucgacucguugccgcucaggaaaagaagaaaaagucacuggguaaaagacuucaggcgaguuugggcgggggaagcuccucucagggcacuaccaagcaacugccugccagcuuacuccacccacuguuccaggcaaugacagacccccuuugccaucugucaagucuaacucucucccacuguaaacugccugaugcugugugccgcgacuugagcgaggcccugagggccgcucccgcauuaaccgagcucggucugcuucauaaucgucugucugaagccggguugcggaugcucucagagggccuggcguggccacaguguagaguccagacagugaggguacaacuaccugauccccagcgcggacugcaguaucuugugggcaugcuccgacagaguccagcucugaccacuuuggaccugagcgggugccaauuaccggccccuaugguuacguaccucugugcaguccugcagcaccagggaugcggccuucaaacacuguccuuggccucuguggaacucucggagcagagccugcaggaacuacaggcugugaagagagcaaagcccgaucuggucauuacccacccagcccuugacggucauccccaaccuccaaaagagcucaucuccacuuucuga

SEQ ID NO: 9093 - RNA, 2679 nt, Artificial Sequence
  derived and/or modified sequence opt4 from NALP6__Homo_sapiens__CCDS7693.1
auggaccagcccgaggcccccugcagcagcaccggccccagacuggccguggccagagagcugcugcuggccgcccuggaggagcugagccaggagcagcugaagagauucagacacaagcugagagacgugggccccgacggcagaagcauccccuggggcagacuggagagagccgacgccguggaccuggccgagcagcuggcccaguucuacggccccgagcccgcccuggagguggccagaaagacccugaagagagccgacgccagagacguggccgcccagcugcaggagagaagacugcagagacugggccugggcagcggcacccugcugagcgugagcgaguacaagaagaaguacagagagcacgugcugcagcugcacgccagagugaaggagagaaacgccagaagcgugaagaucaccaagagauucaccaagcugcugaucgcccccgagagcgccgcccccgaggaggccaugggccccgccgaggagcccgagcccggcagagccagaagaagcgacacccacaccuucaacagacuguucagaagagacgaggagggcagaagaccccugaccguggugcugcagggccccgccggcaucggcaagaccauggccgccaagaagauccuguacgacugggccgccggcaagcuguaccagggccagguggacuucgccuucuucaugcccugcggcgagcugcuggagagacccggcaccagaagccuggccgaccugauccuggaccagugccccgacagaggcgcccccgugccccagaugcuggcccagccccagagacugcuguucauccuggacggcgccgacgagcugcccgcccugggcggccccgaggccgcccccugcaccgaccccuucgaggccgccagcggcgccagagugcugggcggccugcugagcaaggcccugcugcccaccgcccugcugcuggugaccaccagagccgccgcccccggcagacugcagggcagacugugcagcccccagugcgccgaggugagaggcuucagcgacaaggacaagaagaaguacuucuacaaguacuucagagacgagagaagagccgagagagccuacagauucgugaaggagaacgagacccuguucgcccugugcuucgugcccuucgugugcuggaucgugugcaccgugcugagacagcagcuggagcugggcagagaccugagcagaaccagcaagaccaccaccagcguguaccugcuguucaucaccagcgugcugagcagcgcccccguggccgacggccccagacugcagggcgaccugagaaaccugugcagacuggccagagagggcgugcugggcagaagagcccaguucgccgagaaggagcuggagcagcuggagcugagaggcagcaaggugcagacccuguuccugagcaagaaggagcugcccggcgugcuggagaccgaggugaccuaccaguucaucgaccagagcuuccaggaguuccuggccgcccugagcuaccugcuggaggacggcggcgugcccagaaccgccgccggcggcgugggcacccugcugagaggcgacgcccagccccacagccaccuggugcugaccaccagauuccuguucggccugcugagcgccgagagaaugagagacaucgagagacacuucggcugcauggugagcgagagagugaagcaggaggcccugagaugggugcagggccagggccagggcugccccggcguggcccccgaggugaccgagggcgccaagggccuggaggacaccgaggagcccgaggaggaggaggagggcgaggagcccaacuacccccuggagcugcuguacugccuguacgagacccaggaggacgccuucgugagacaggcccugugcagauuccccgagcuggcccugcagagagugagauucugcagaauggacguggccgugcugagcuacugcgugagaugcugccccgccggccaggcccugagacugaucagcugcagacugguggccgcccaggagaagaagaagaagagccugggcaagagacugcaggccagccugggcggcggcagcagcagccagggcaccaccaagcagcugcccgccagccugcugcacccccuguuccaggccaugaccgacccccugugccaccugagcagccugacccugagccacugcaagcugcccgacgccgugugcagagaccugagcgaggcccugagagccgcccccgcccugaccgagcugggccugcugcacaacagacugagcgaggccggccugagaaugcugagcgagggccuggccuggccccagugcagagugcagaccgugagagugcagcugcccgacccccagagaggccugcaguaccuggugggcaugcugagacagagccccgcccugaccacccuggaccugagcggcugccagcugcccgcccccauggugaccuaccugugcgccgugcugcagcaccagggcugcggccugcagacccugagccuggccagcguggagcugagcgagcagagccugcaggagcugcaggccgugaagagagccaagcccgaccuggugaucacccaccccgcccuggacggccacccccagccccccaaggagcugaucagcaccuucuga

SEQ ID NO: 9094 - RNA, 2679 nt, Artificial Sequence
  derived and/or modified sequence opt5 from NALP6__Homo_sapiens__CCDS7693.1
auggaccagcccgaggccccuugcagcuccaccggcccgagacuggcuguggcccgggaacuccugcuugcggcucuggaggaacucucucaagagcagcugaagcgcuucagacacaaacuucgggaugucgggcccgacggacgcagcaucccuuggggcagacuggaacgggccgaugccguugaccucgcugagcagcuggcccaguuuuacgggcccgagccugcucuggaaguggcccgcaagacacucaaaagagcggaugcccgggacguggcugcccaacugcaggagcgcagacuucagcggcugggacucggcuccgggacgcugcuuucugucagcgaauauaagaaaaaguaccgcgagcaugugcugcagcuccacgcuagaguuaaggagcggaacgcccgcuccgugaaaauuaccaagagauucacaaaacugcugaucgcgcccgaaucugccgcuccugaggaagccaugggaccggcugaggaacccgagccuggccgggccagacgcagcgauacccauacauuuaaucggcuguucagacgcgacgaggaaggccggagaccccugaccgucgugcuucaagggccugccggaauuggcaagacaauggcugcgaaaaagauccuguaugauugggccgcugggaagcucuaccagggacagguugacuuugccuucuuuaugcccuguggcgagcugcuugaacgcccggggacccggucccuggccgaucucauucuggaccagugcccugauagaggagcucccgugccucaaaugcuggcccagccccagcgccuccuguucauccuugacggcgcggacgagcugcccgcucucggcgggccugaagccgccccguguacggaucccuuugaggcugccagcggagcucggguccugggcgggcuucugucuaaagcccuccugccuaccgcgcugcuccuggugacaaccagagccgcugcccccggacgccuucaaggccggcugugcuccccucagugugcugaggugagaggguucagcgacaaggauaaaaagaaauauuuuuacaaguauuuccgggacgaacgcagagccgagcgggcguacagauuugucaaagaaaacgagacacucuucgcccugugcuucguucccuuuguguguuggaucgugugcaccguccugcgccagcagcuugaacucggacgggaucugucuagaacguccaagacaaccacaagcguguaccuccucuucauuaccucuguucuguccagcgcuccgguggccgacggcccucgccuucaaggcgaucugagaaaucucugucggcuggcucgcgaggggguccugggaagacgggcccaguuugccgagaaggaacuugagcagcucgaacugcgcggcuccaaagugcagacccuguuccucucuaagaaagagcugcccgggguucuugagacagaagugacguaucaauuuaucgaccagagcuuccaggaguuucuggcugcgcucuccuaccugcuggaagauggaggcgucccuagaaccgccgcugggggcgugggaacacuucuccggggcgacgcccagccccacagccaucugguccugaccacacgcuuccucuuugggcugcuuucugccgagagaaugcgggauauugaacgccacuucggaugcaugguguccgagagaguuaagcaagaggcucugcggugggugcagggccaggggcagggauguccuggcgucgcccccgaagugaccgagggggcgaaaggccucgaagacacggaggaaccggaggaggaagaggaaggagaggaaccuaacuauccccuggagcugcuuuacugccucuaugagacacaagaagacgcuuuuguuagacaggcccugugccgcuuccccgagcuggcccuccagcgggugagauuuugucgcauggaugucgcugugcugagcuacugcgugcgguguugcccugccggccaagcgcuuagacugaucucuugucgccucguugcugcccaggaaaagaagaaaaagagccuggggaaacggcugcaggccucccuuggaggcgggucuagcucccagggaaccaccaagcaacugccggcuagccuccugcacccccucuuccaggccaugacagacccucugugccaucuuucuucccugacccucagccacuguaaacugcccgaugcugucugcagagaccugucugaggcccuucgcgcggccccugcucugacagagcucggccugcuccauaaucggcuguccgaagccgggcuuagaaugcugagcgagggccucgcuuggccccagugucgggugcagacggugcgcguccaacugccugauccccagagaggacugcaguaucuugugggcaugcugcggcaguccccggcccucaccacacuggaccucucugggugccaacugccugcccccaugguuaccuaccuuugugcugugcugcagcaccagggaugcggccugcaaacacucagccuggcguccgucgaacuuucugagcagagccugcaggaacuccaggccgugaagcgcgcuaagccugaucugguuauuacccaccccgcccucgacgggcauccgcaaccucccaaagagcugaucuccacguucuga

SEQ ID NO: 9095 - protein, 980 aa, Artificial Sequence
  NALP7__Homo_sapiens__Q8WX94
MTSPQLEWTLQTLLEQLNEDELKSFKSLLWAFPLEDVLQKTPWSEVEEADGKKLAEILVNTSSENWIRNATVNILEEMNLTELCKMAKAEMMEDGQVQEIDNPELGDAEEDSELAKPGEKEGWRNSMEKQSLVWKNTFWQGDIDNFHDDVTLRNQRFIPFLNPRTPRKLTPYTVVLHGPAGVGKTTLAKKCMLDWTDCNLSPTLRYAFYLSCKELSRMGPCSFAELISKDWPELQDDIPSILAQAQRILFVVDGLDELKVPPGALIQDICGDWEKKKPVPVLLGSLLKRKMLPRAALLVTTRPRALRDLQLLAQQPIYVRVEGFLEEDRRAYFLRHFGDEDQAMRAFELMRSNAALFQLGSAPAVCWIVCTTLKLQMEKGEDPVPTCLTRTGLFLRFLCSRFPQGAQLRGALRTLSLLAAQGLWAQMSVFHREDLERLGVQESDLRLFLDGDILRQDRVSKGCYSFIHLSFQQFLTALFYALEKEEGEDRDGHAWDIGDVQKLLSGEERLKNPDLIQVGHFLFGLANEKRAKELEATFGCRMSPDIKQELLQCKAHLHANKPLSVTDLKEVLGCLYESQEEELAKVVVAPFKEISIHLTNTSEVMHCSFSLKHCQDLQKLSLQVAKGVFLENYMDFELDIEFERCTYLTIPNWARQDLRSLRLWTDFCSLFSSNSNLKFLEVKQSFLSDSSVRILCDHVTRSTCHLQKVEIKNVTPDTAYRDFCLAFIGKKTLTHLTLAGHIEWERTMMLMLCDLLRNHKCNLQYLRLGGHCATPEQWAEFFYVLKANQSLKHLRLSANVLLDEGAMLLYKTMTRPKHFLQMLSLENCRLTEASCKDLAAVLVVSKKLTHLCLAKNPIGDTGVKFLCEGLSYPDCKLQTLVLQQCSITKLGCRYLSEALQEACSLTNLDLSINQIARGLWILCQALENPNCNLKHLRLKTYETNLEIKKLLEEVKEKNPKLTIDCNASGATAPPCCDFFC

SEQ ID NO: 9096 - RNA, 2943 nt, Artificial Sequence
  NALP7__Homo_sapiens__AAL69963
augacaucgccccagcuagaguggacucugcagacccuucuggagcagcugaacgaggaugaauuaaagaguuucaaaucccuuuuaugggcuuuuccccucgaagacgugcuacagaagaccccauggucugagguggaagaggcugauggcaagaaacuggcagaaauucuggucaacaccuccucagaaaauuggauaaggaaugcgacugugaacaucuuggaagagaugaaucucacggaauuguguaagauggcaaaggcugagaugauggaggacggacaggugcaagaaauagauaauccugagcugggagaugcagaagaagacucggaguuagcaaagccaggugaaaaggaaggauggagaaauucaauggagaaacagucuuuggucuggaagaacaccuuuuggcaaggagacauugacaauuuccaugacgacgucacucugagaaaccaacgguucauuccauucuugaaucccagaacacccaggaagcuaacaccuuacacgguggugcugcacggccccgcaggcguggggaaaaccacgcuggccaaaaaguguaugcuggacuggacagacugcaaccucagcccgacgcucagauacgcguucuaccucagcugcaaggagcucagccgcaugggccccugcaguuuugcagagcugaucuccaaagacuggccugaauugcaggaugacauuccaagcauccuagcccaagcacagagaauccuguucguggucgauggccuugaugagcugaaagucccaccuggggcgcugauccaggacaucugcggggacugggagaagaagaagccggugcccguccuccuggggaguuugcugaagaggaagauguuacccagggcagccuugcuggucaccacgcggcccagggcacugagggaccuccagcuccuggcgcagcagccgaucuacguaaggguggagggcuuccuggaggaggacaggagggccuauuuccugagacacuuuggagacgaggaccaagccaugcgugccuuugagcuaaugaggagcaacgcggcccuguuccagcugggcucggcccccgcggugugcuggauugugugcacgacucugaagcugcagauggagaagggggaggacccgguccccaccugccucacccgcacggggcuguuccugcguuuccucugcagccgguucccgcagggcgcacagcugcggggcgcgcugcggacgcugagccuccuggccgcgcagggccugugggcgcagauguccguguuccaccgagaggaccuggaaaggcucggggugcaggaguccgaccuccgucuguuccuggacggagacauccuccgccaggacagagucuccaaaggcugcuacuccuucauccaccucagcuuccagcaguuucucacugcccuguucuacgcccuggagaaggaggagggggaggacagggacggccacgccugggacaucggggacguacagaagcugcuuuccggagaagaaagacucaagaaccccgaccugauucaaguaggacacuucuuauucggccucgcuaacgagaagagagccaaggaguuggaggccacuuuuggcugccggaugucaccggacaucaaacaggaauugcugcaaugcaaagcacaucuucaugcaaauaagcccuuauccgugaccgaccugaaggaggucuugggcugccuguaugagucucaggaggaggagcuggcgaagguggugguggccccguucaaggaaauuucuauucaccugacaaauacuucugaagugaugcauuguuccuucagccugaagcauugucaagacuugcagaaacucucacugcagguagcaaaggggguguuccuggagaauuacauggauuuugaacuggacauugaauuugaaaggugcacuuaccuaaccauuccgaacugggcucggcaggaucuucgcucucuucgccucuggacagauuucugcucucucuucagcucaaacagcaaccucaaguuucuggaagugaaacaaagcuuccugagugacucuucugugcggauucuuugugaccacguaacccguagcaccugucaucugcagaaaguggagauuaaaaacgucaccccugacaccgcguaccgggacuucugucuugcuuucauugggaagaagacccucacgcaccugacccuggcagggcacaucgagugggaacgcacgaugaugcugaugcugugugaccugcucagaaaucauaaaugcaaccugcaguaccugagguugggaggucacugugccaccccggagcagugggcugaauucuucuauguccucaaagccaaccagucccugaagcaccugcgucucucagccaaugugcuccuggaugagggugccauguugcuguacaagaccaugacacgcccaaaacacuuccugcagauguugucguuggaaaacugucgucuuacagaagccaguugcaaggaccuugcugcugucuugguugucagcaagaagcugacacaccugugcuuggccaagaaccccauuggggauacaggggugaaguuucugugugagggcuugaguuacccugauuguaaacugcagaccuugguguuacagcaaugcagcauaaccaagcuuggcuguagauaucucucagaggcgcuccaagaagccugcagccucacaaaccuggacuugaguaucaaccagauagcucguggauuguggauucucugucaggcauuagagaauccaaacuguaaccuaaaacaccuacgguugaagaccuaugaaacuaauuuggaaaucaagaagcuguuggaggaagugaaagaaaagaaucccaagcugacuauugauugcaaugcuuccggggcaacggcaccuccgugcugugacuuuuuuugcuga

SEQ ID NO: 9097 - RNA, 2943 nt, Artificial Sequence
  derived and/or modified sequence opt1 from NALP7__Homo_sapiens__AAL69963
augaccagcccccagcuggaguggacccuccagacgcugcuggagcagcucaacgaggacgagcugaaguccuucaagagccugcucugggccuucccccuggaggacgugcugcagaagacccccugguccgaggucgaggaggccgacggcaagaagcucgcggagauccuggugaacaccagcuccgagaacuggauccgcaacgccaccgugaacauccuggaggagaugaaccucacggagcugugcaagauggccaaggccgagaugauggaggacgggcagguccaggagaucgacaaccccgagcugggcgacgccgaggaggacagcgagcucgcgaagcccggggagaaggagggcuggcggaacuccauggagaagcagagccugguguggaagaacaccuucuggcagggggacaucgacaacuuccacgacgacgugacccugcgcaaccagcgguucaucccguuccucaacccccgcacgccccggaagcugacccccuacaccgucgugcugcacggcccggccggcguggggaagaccacccucgccaagaagugcaugcuggacuggacggacugcaaccugucccccacccuccgcuacgccuucuaccugagcugcaaggagcugucccggaugggccccugcagcuucgcggagcucaucuccaaggacuggcccgagcugcaggacgacaucccgagcauccuggcccaggcccagcgcauccucuucgucguggacgggcuggacgagcugaaggugccgcccggcgcccucauccaggacaucugcggggacugggagaagaagaagcccguccccgugcugcugggcucccuccugaagcggaagaugcugccccgcgccgcgcuccuggugaccacccggccccgcgcccugcgggaccuccagcugcuggcccagcagcccaucuacguccgcguggagggcuuccucgaggaggaccggcgcgccuacuuccugcggcacuucggggacgaggaccaggccaugcgcgcguucgagcugaugcggagcaacgccgcccucuuccagcugggcuccgccccggccgugugcuggaucgucugcacgacccugaagcugcagauggagaagggggaggaccccgugccgaccugccucacccgcacgggccuguuccugcgguuccucugcagccgcuucccccagggcgcgcagcugcgcggggcccugcggacccucucccugcuggccgcccagggccucugggcccagaugagcguguuccaccgcgaggaccuggagcggcuggggguccaggagagcgaccuccgccuguuccuggacggcgacauccuccggcaggaccgcguguccaaggggugcuacagcuucauccaccuguccuuccagcaguuccugaccgcgcuguucuacgcccuggagaaggaggagggcgaggaccgggacggccacgccugggacaucggggacgugcagaagcugcucagcggcgaggagcgccugaagaaccccgaccugauccaggucgggcacuuccucuucggccuggccaacgagaagcgggcgaaggagcuggaggccaccuucgggugccgcaugucccccgacaucaagcaggagcuccugcagugcaaggcccaccuccacgccaacaagccccucagcgugacggaccugaaggagguccugggcugccucuacgagucccaggaggaggagcuggccaaggugguggucgcgcccuucaaggagaucagcauccaccugaccaacaccuccgaggugaugcacugcagcuucucccucaagcacugccaggaccugcagaagcugagccuccagguggccaagggcgucuuccuggagaacuacauggacuucgagcuggacaucgaguucgagcggugcaccuaccucacgaucccgaacugggcccgccaggaccugcggucccugcgccucuggaccgacuucugcagccuguucuccagcaacuccaaccugaaguuccucgaggugaagcagagcuuccuguccgacagcagcgugcggauccugugcgaccacgucacccgcuccacgugccaccuccagaagguggagaucaagaacgugacccccgacaccgccuaccgggacuucugccuggccuucaucgggaagaagacccugacccaccucacgcuggcgggccacaucgagugggagcgcaccaugaugcugaugcucugcgaccugcugcggaaccacaagugcaaccuccaguaccugcgccucgggggccacugcgccacccccgagcagugggccgaguucuucuacguccugaaggccaaccagagccugaagcaccuccgccuguccgccaacgugcugcuggacgagggggcgaugcuccuguacaagaccaugacccggccgaagcacuuccugcagaugcucagccuggagaacugccgccugacggaggccuccugcaaggaccucgccgccgugcuggucgugagcaagaagcugacccaccucugccuggcgaagaaccccaucggcgacaccggcgugaaguuccugugcgaggggcucuccuaccccgacugcaagcugcagacccugguccuccagcagugcagcaucacgaagcugggcugccgguaccuguccgaggcccuccaggaggccugcagccugaccaaccuggaccucuccaucaaccagaucgcccgcgggcuguggauccugugccaggcccucgagaaccccaacugcaaccugaagcaccuccggcugaagaccuacgagaccaaccuggagaucaagaagcugcuggaggaggugaaggagaagaacccgaagcucacgaucgacugcaacgcgagcggcgccaccgccccgcccugcugcgacuucuucugcuga

SEQ ID NO: 9098 - RNA, 2943 nt, Artificial Sequence
  derived and/or modified sequence opt2 from NALP7__Homo_sapiens__AAL69963
augaccuccccccagcucgaguggacccuccagacccuccucgagcagcucaacgaggacgagcucaaguccuucaagucccuccucugggccuucccccucgaggacguccuccagaagacccccugguccgaggucgaggaggccgacggcaagaagcucgccgagauccucgucaacaccuccuccgagaacuggauccgcaacgccaccgucaacauccucgaggagaugaaccucaccgagcucugcaagauggccaaggccgagaugauggaggacggccagguccaggagaucgacaaccccgagcucggcgacgccgaggaggacuccgagcucgccaagcccggcgagaaggagggcuggcgcaacuccauggagaagcagucccucgucuggaagaacaccuucuggcagggcgacaucgacaacuuccacgacgacgucacccuccgcaaccagcgcuucauccccuuccucaacccccgcaccccccgcaagcucacccccuacaccgucguccuccacggccccgccggcgucggcaagaccacccucgccaagaagugcaugcucgacuggaccgacugcaaccucucccccacccuccgcuacgccuucuaccucuccugcaaggagcucucccgcaugggccccugcuccuucgccgagcucaucuccaaggacuggcccgagcuccaggacgacauccccuccauccucgcccaggcccagcgcauccucuucgucgucgacggccucgacgagcucaaggucccccccggcgcccucauccaggacaucugcggcgacugggagaagaagaagcccguccccguccuccucggcucccuccucaagcgcaagaugcucccccgcgccgcccuccucgucaccacccgcccccgcgcccuccgcgaccuccagcuccucgcccagcagcccaucuacguccgcgucgagggcuuccucgaggaggaccgccgcgccuacuuccuccgccacuucggcgacgaggaccaggccaugcgcgccuucgagcucaugcgcuccaacgccgcccucuuccagcucggcuccgcccccgccgucugcuggaucgucugcaccacccucaagcuccagauggagaagggcgaggaccccguccccaccugccucacccgcaccggccucuuccuccgcuuccucugcucccgcuucccccagggcgcccagcuccgcggcgcccuccgcacccucucccuccucgccgcccagggccucugggcccagauguccgucuuccaccgcgaggaccucgagcgccucggcguccaggaguccgaccuccgccucuuccucgacggcgacauccuccgccaggaccgcgucuccaagggcugcuacuccuucauccaccucuccuuccagcaguuccucaccgcccucuucuacgcccucgagaaggaggagggcgaggaccgcgacggccacgccugggacaucggcgacguccagaagcuccucuccggcgaggagcgccucaagaaccccgaccucauccaggucggccacuuccucuucggccucgccaacgagaagcgcgccaaggagcucgaggccaccuucggcugccgcaugucccccgacaucaagcaggagcuccuccagugcaaggcccaccuccacgccaacaagccccucuccgucaccgaccucaaggagguccucggcugccucuacgagucccaggaggaggagcucgccaaggucgucgucgcccccuucaaggagaucuccauccaccucaccaacaccuccgaggucaugcacugcuccuucucccucaagcacugccaggaccuccagaagcucucccuccaggucgccaagggcgucuuccucgagaacuacauggacuucgagcucgacaucgaguucgagcgcugcaccuaccucaccauccccaacugggcccgccaggaccuccgcucccuccgccucuggaccgacuucugcucccucuucuccuccaacuccaaccucaaguuccucgaggucaagcaguccuuccucuccgacuccuccguccgcauccucugcgaccacgucacccgcuccaccugccaccuccagaaggucgagaucaagaacgucacccccgacaccgccuaccgcgacuucugccucgccuucaucggcaagaagacccucacccaccucacccucgccggccacaucgagugggagcgcaccaugaugcucaugcucugcgaccuccuccgcaaccacaagugcaaccuccaguaccuccgccucggcggccacugcgccacccccgagcagugggccgaguucuucuacguccucaaggccaaccagucccucaagcaccuccgccucuccgccaacguccuccucgacgagggcgccaugcuccucuacaagaccaugacccgccccaagcacuuccuccagaugcucucccucgagaacugccgccucaccgaggccuccugcaaggaccucgccgccguccucgucgucuccaagaagcucacccaccucugccucgccaagaaccccaucggcgacaccggcgucaaguuccucugcgagggccucuccuaccccgacugcaagcuccagacccucguccuccagcagugcuccaucaccaagcucggcugccgcuaccucuccgaggcccuccaggaggccugcucccucaccaaccucgaccucuccaucaaccagaucgcccgcggccucuggauccucugccaggcccucgagaaccccaacugcaaccucaagcaccuccgccucaagaccuacgagaccaaccucgagaucaagaagcuccucgaggaggucaaggagaagaaccccaagcucaccaucgacugcaacgccuccggcgccaccgccccccccugcugcgacuucuucugcuga

SEQ ID NO: 9099 - RNA, 2943 nt, Artificial Sequence
  derived and/or modified sequence opt3 from NALP7__Homo_sapiens__AAL69963
augaccagcccccagcuggaauggacacuccaaacucuucuggaacaguugaacgaggacgaauuaaaguccuucaaaucucugcuaugggccuuuccucucgaggaugugcugcagaagacgccauggucagaagucgaggaggcugacggcaaaaagcuggcagaaauccuuguuaauaccaguagcgagaacuggauuagaaaugccacagugaacauauuggaagagaugaaucucacugagcugugcaaaauggcgaaggcugaaaugauggaggaugggcagguacaagaaaucgacaacccggagcugggagaugccgaagaggacuccgagcucgcaaagcccggugaaaaagagggcuggagaaauucuauggaaaagcagucguuaguguggaaaaacaccuucuggcagggggauauugacaauuuucacgaugacgucacacugcggaaccagcgcuucaucccuuuucuuaauccacgaacuccccguaaguugaccccuuacacagugguucugcauggaccagccggcguggguaaaaccacgcuagcuaagaaguguaugcucgauuggacugacugcaaccugucacccacccuuagauaugcauucuaccugagcuguaaagaguugaguaggauggggccuugcuccuuugccgaacucauuucuaaggauuggccagagcugcaagacgacaucccgagcauauuagcucaggcccagcggauccuguucgucguggauggacucgacgagcuuaaaguacccccuggcgcgcugauucaggauaucuguggcgacugggaaaagaaaaagccaguucccguguugcuagggucccugcucaaacgcaagaugcugccuagagcagcccuucuggucacaacuaggccacgggcuuugcgcgaucuccaacuguuagcccagcagcccauuuaugugcgaguggagggauuucuggaagaggacagaagggcauacuuccuacggcacuuuggugaugaagaccaagcuaugcgugccuucgagcucaugcgcucaaaugcggcccuguuucagcuuggcagugcaccggcugucugcuggaucguuuguaccacauugaagcugcagauggagaaaggggaagauccugugccaaccugccucacgagaacuggacuguuccuuagguuccuguguagccgguuuccccagggcgcccaauugcgaggugcucuccgcacacugucuuuacuggccgcacaggggcuaugggcccagauguccguauuccauagagaggaccucgaaaggcugggagugcaggagucagaucuucgguuguuucuggacggcgacauacuccgccaagauagagucagcaagggcugcuauaguuucauucaccugucuuuucagcaguucuuaaccgcucuguuuuacgcgcuugagaaagaagagggggaagacagggauggacaugcaugggacaucggugaugugcagaaguugcucuccggcgaggaacgucugaaaaacccugaccuaauucaaguugggcacuuccuguuuggacucgccaaugagaagcgggcuaaggagcuggaagccacuuucggcugucgaaugagccccgauaucaaacaggagcuuuugcagugcaaggcacaucugcacgccaacaaaccauuaucggugacagaccucaaggaaguccuggguugccuuuaugagucucaggaagaggagcuggcuaaagugguaguugcccccuuuaaggaaaucuccauucacuugaccaacacgucagaggugaugcauuguaguuucagccucaagcacugccaagaucugcagaaacuaucccugcaggucgcaaaggggguguuucucgaaaauuacauggacuucgagcuggauauagaguucgaaagauguaccuaccuuacaaucccuaacugggcgaggcaagacuugcgcucucugcgguuauggacugauuuuugcagccucuucucaaguaauuccaaccugaaauuucuugaggucaagcagagcuuccugucugacucaagugugaggauucuaugugaccacguuaccaggagcacaugccaucuccagaaaguggaaaucaagaauguaacuccagauaccgcuuaucgcgacuuuugucuggccuucauaggcaagaaaacauugacccaccugacuuuagcaggacauauugagugggaacgaacgaugaugcucaugcugugcgaucuucugcggaaccacaaguguaauuugcaguaccuccgucugggcgggcauugcgccacaccggagcaaugggcugaguuuuucuauguccuaaaagccaaccagucccugaagcaccuuagacucucugcaaaugugcuguuggacgaaggagcuaugcuguuauacaaaaccaugacuaggcccaagcacuuucuccagaugcugucgcuugagaacugucgccugaccgaagccagcugcaaagauuuggcggccguucucguggucuccaagaagcugacacaucuaugccuggcuaaaaauccuaucggugacaccggcgugaaguuccuuugugaggggcucucauauccagauugcaaacugcagacuuugguauuacaacaguguaguaucacaaagcugggaugccgguaccucucugaagcacugcaggaggccuguagccuuacgaaccuggacuuguccauuaaucagaucgcuagaggccuauggauucugugccaagcccucgagaaccccaauuguaaccugaaacaccuuagguuaaagaccuaugaaacuaaccuggagauaaagaaacucuuggaagaggugaaggagaaaaauccuaagcugacaaucgauugcaacgcaucaggugcgaccgccccacccuguugcgacuuuuucuguuga

SEQ ID NO: 9100 - RNA, 2943 nt, Artificial Sequence
  derived and/or modified sequence opt4 from NALP7__Homo_sapiens__AAL69963
augaccagcccccagcuggaguggacccugcagacccugcuggagcagcugaacgaggacgagcugaagagcuucaagagccugcugugggccuucccccuggaggacgugcugcagaagacccccuggagcgagguggaggaggccgacggcaagaagcuggccgagauccuggugaacaccagcagcgagaacuggaucagaaacgccaccgugaacauccuggaggagaugaaccugaccgagcugugcaagauggccaaggccgagaugauggaggacggccaggugcaggagaucgacaaccccgagcugggcgacgccgaggaggacagcgagcuggccaagcccggcgagaaggagggcuggagaaacagcauggagaagcagagccugguguggaagaacaccuucuggcagggcgacaucgacaacuuccacgacgacgugacccugagaaaccagagauucauccccuuccugaaccccagaacccccagaaagcugacccccuacaccguggugcugcacggccccgccggcgugggcaagaccacccuggccaagaagugcaugcuggacuggaccgacugcaaccugagccccacccugagauacgccuucuaccugagcugcaaggagcugagcagaaugggccccugcagcuucgccgagcugaucagcaaggacuggcccgagcugcaggacgacauccccagcauccuggcccaggcccagagaauccuguucgugguggacggccuggacgagcugaaggugccccccggcgcccugauccaggacaucugcggcgacugggagaagaagaagcccgugcccgugcugcugggcagccugcugaagagaaagaugcugcccagagccgcccugcuggugaccaccagacccagagcccugagagaccugcagcugcuggcccagcagcccaucuacgugagaguggagggcuuccuggaggaggacagaagagccuacuuccugagacacuucggcgacgaggaccaggccaugagagccuucgagcugaugagaagcaacgccgcccuguuccagcugggcagcgcccccgccgugugcuggaucgugugcaccacccugaagcugcagauggagaagggcgaggaccccgugcccaccugccugaccagaaccggccuguuccugagauuccugugcagcagauucccccagggcgcccagcugagaggcgcccugagaacccugagccugcuggccgcccagggccugugggcccagaugagcguguuccacagagaggaccuggagagacugggcgugcaggagagcgaccugagacuguuccuggacggcgacauccugagacaggacagagugagcaagggcugcuacagcuucauccaccugagcuuccagcaguuccugaccgcccuguucuacgcccuggagaaggaggagggcgaggacagagacggccacgccugggacaucggcgacgugcagaagcugcugagcggcgaggagagacugaagaaccccgaccugauccaggugggccacuuccuguucggccuggccaacgagaagagagccaaggagcuggaggccaccuucggcugcagaaugagccccgacaucaagcaggagcugcugcagugcaaggcccaccugcacgccaacaagccccugagcgugaccgaccugaaggaggugcugggcugccuguacgagagccaggaggaggagcuggccaagguggugguggcccccuucaaggagaucagcauccaccugaccaacaccagcgaggugaugcacugcagcuucagccugaagcacugccaggaccugcagaagcugagccugcagguggccaagggcguguuccuggagaacuacauggacuucgagcuggacaucgaguucgagagaugcaccuaccugaccauccccaacugggccagacaggaccugagaagccugagacuguggaccgacuucugcagccuguucagcagcaacagcaaccugaaguuccuggaggugaagcagagcuuccugagcgacagcagcgugagaauccugugcgaccacgugaccagaagcaccugccaccugcagaagguggagaucaagaacgugacccccgacaccgccuacagagacuucugccuggccuucaucggcaagaagacccugacccaccugacccuggccggccacaucgagugggagagaaccaugaugcugaugcugugcgaccugcugagaaaccacaagugcaaccugcaguaccugagacugggcggccacugcgccacccccgagcagugggccgaguucuucuacgugcugaaggccaaccagagccugaagcaccugagacugagcgccaacgugcugcuggacgagggcgccaugcugcuguacaagaccaugaccagacccaagcacuuccugcagaugcugagccuggagaacugcagacugaccgaggccagcugcaaggaccuggccgccgugcugguggugagcaagaagcugacccaccugugccuggccaagaaccccaucggcgacaccggcgugaaguuccugugcgagggccugagcuaccccgacugcaagcugcagacccuggugcugcagcagugcagcaucaccaagcugggcugcagauaccugagcgaggcccugcaggaggccugcagccugaccaaccuggaccugagcaucaaccagaucgccagaggccuguggauccugugccaggcccuggagaaccccaacugcaaccugaagcaccugagacugaagaccuacgagaccaaccuggagaucaagaagcugcuggaggaggugaaggagaagaaccccaagcugaccaucgacugcaacgccagcggcgccaccgccccccccugcugcgacuucuucugcuga

SEQ ID NO: 9101 - RNA, 2943 nt, Artificial Sequence
  derived and/or modified sequence opt5 from NALP7__Homo_sapiens__AAL69963
augaccagcccccagcuggaguggacacuccaaacgcugcuugaacagcugaacgaggacgaacucaaguccuucaaaucucugcuuugggccuuuccccuggaggaugugcuccagaagaccccguggagcgaagucgaggaggcugacggcaaaaagcuggccgaaauccugguuaauacauccucugagaacuggauuagaaaugcgaccgugaacauccucgaagagaugaaucugacagagcuuugcaaaauggcuaaggccgaaaugauggaggauggacaggugcaagaaauugacaaccccgagcugggggaugccgaagaggacagcgagcucgcuaagccuggcgaaaaagagggguggcgcaauuccauggaaaagcagucucuggucuggaaaaacaccuucuggcagggagauaucgacaauuuucacgaugacgugacacuucggaaccagagauucauucccuuucugaauccucggacgccccgcaagcucaccccuuacaccguugugcugcacggcccggccggggucggaaaaacaacccuggcuaagaaguguaugcucgauuggacagacugcaaccugagccccacccuuagauaugccuucuaccuguccuguaaagagcucagccggaugggcccuugcucuuuugcggaacugaucuccaaggauuggcccgagcuucaagacgacaucccuagcauucuggcccaggcucagcgcauccucuucgugguugauggccuggacgagcugaaagugcccccgggggcccucauucaggauaucuguggagacugggaaaagaaaaagccuguccccgugcugcuuggcucucugcucaaaagaaagaugcugccucgggcugcccuucuggugacgacacgccccagagcgcuccgggaucugcaacugcucgcccagcagcccauuuauguccgcguugagggguuucuggaagaggacagacgggcuuacuuccuucgccacuuuggagaugaagaccaagccaugagagcuuucgagcugaugcgguccaaugccgcccucuuucagcugggcagcgcuccugcggugugcuggaucguguguaccacacugaaacuucagauggagaaaggggaagauccggucccuaccugccucaccagaacaggacuguuccugcgcuuccucuguucucgguuuccccagggcgcccaacugagaggcgcccuucgcacgcugucccuccuggcugcccaggggcugugggcucagaugagcguguuccaucgggaggaccuugaaagacucggaguucaggaguccgaucugcgccuguuucucgacggcgacauucugcggcaagauagagugucuaaggggugcuauagcuucauccaccuuuccuuucagcaguuccugaccgcccucuuuuacgcgcuggagaaagaagagggagaagaccgcgauggccaugcuugggacaucggggauguccagaagcugcuuagcggagaggaacggcucaaaaaccccgaccugauucaagugggccacuuccuguuuggccucgccaaugagaagagagccaaggagcuggaagcuacauucgggugucgcaugucuccugauaucaaacaggagcuucugcagugcaaggcccaccuccaugcuaacaaaccccuguccguuaccgaccugaaggaagugcuuggaugccucuaugagagccaggaagaggagcuggccaaagucguggucgcgccguuuaaggaaauuucuauccaccugacaaacaccagcgaggugaugcauuguuccuucucucucaagcacugccaagaucugcagaaacuuagccugcagguugccaagggcguguuucucgaaaauuacauggacuucgagcuggauauugaguucgaacgguguacguaccugacaaucccuaacugggcuagacaagaccuucggucccugcgccucuggaccgauuuuugcagccuguucucuuccaauagcaaccucaaauuucuggaggucaagcagucuuuccuuuccgacagcuccgugagaauccugugugaccacguuacccggucuacaugccaucuccagaaaguggaaauuaagaaugucacccccgauacagccuauagagacuuuugucuggcuuucaucgggaagaaaacgcugacccaccuuacacuggccggacauauugagugggaacgcaccaugaugcucaugcugugcgaucuccugcggaaccacaaguguaaucuucaguaccugagacucggcgggcauugcgcgacaccugagcaaugggccgaguuuuucuaugugcugaaagcuaaccagagccugaagcaccuucgccuguccgccaaugugcuccuggacgaaggcgcuaugcuccuguacaaaaccaugacgagacccaagcacuuucuucagaugcugucucuggagaacugucggcucaccgaagccagcugcaaagaucuggccgcuguucuugucguguccaagaagcugacacaucucugccuggcgaaaaauccuaucggagacaccggcgugaaguuccucugugaggggcugagcuaucccgauugcaaacuucagacacugguccugcaacaguguucuauuaccaagcucggaugccgcuaccuguccgaagcccuucaggaggcuuguagccugacgaaccucgaccugucuaucaaucagaucgccagaggccucuggauucugugccaagcccuugagaacccgaauuguaaccugaaacaucugcggcucaagacauaugaaaccaaccuggagaucaagaaacuucuggaagaggugaaggaaaagaauccuaagcucacaauugauugcaacgcuuccggggccaccgcgccucccuguugcgacuuuuucuguuga

SEQ ID NO: 9102 - protein, 1048 aa, Artificial Sequence
  NALP8__Homo_sapiens__Q86W28
MSDVNPPSDTPIPFSSSSTHSSHIPPWTFSCYPGSPCENGVMLYMRNVSHEELQRFKQLLLTELSTGTMPITWDQVETASWAEVVHLLIERFPGRRAWDVTSNIFAIMNCDKMCVVVRREINAILPTLEPEDLNVGETQVNLEEGESGKIRRYKSNVMEKFFPIWDITTWPGNQRDFFYQGVHRHEEYLPCLLLPKRPQGRQPKTVAIQGAPGIGKTILAKKVMFEWARNKFYAHKRWCAFYFHCQEVNQTTDQSFSELIEQKWPGSQDLVSKIMSKPDQLLLLLDGFEELTSTLIDRLEDLSEDWRQKLPGSVLLSSLLSKTMLPEATLLIMIRFTSWQTCKPLLKCPSLVTLPGFNTMEKIKYFQMYFGHTEEGDQVLSFAMENTILFSMCRVPVVCWMVCSGLKQQMERGNNLTQSCPNATSVFVRYISSLFPTRAENFSRKIHQAQLEGLCHLAADSMWHRKWVLGKEDLEEAKLDQTGVTAFLGMSILRRIAGEEDHYVFTLVTFQEFFAALFYVLCFPQRLKNFHVLSHVNIQRLIASPRGSKSYLSHMGLFLFGFLNEACASAVEQSFQCKVSFGNKRKLLKVIPLLHKCDPPSPGSGVPQLFYCLHEIREEAFVSQALNDYHKVVLRIGNNKEVQVSAFCLKRCQYLHEVELTVTLNFMNVWKLSSSSHPGSEAPESNGLHRWWQDLCSVFATNDKLEVLTMTNSVLGPPFLKALAAALRHPQCKLQKLLLRRVNSTMLNQDLIGVLTGNQHLRYLEIQHVEVESKAVKLLCRVLRSPRCRLQCLRLEDCLATPRIWTDLGNNLQGNGHLKTLILRKNSLENCGAYYLSVAQLERLSIENCNLTQLTCESLASCLRQSKMLTHLSLAENALKDEGAKHIWNALPHLRCPLQRLVLRKCDLTFNCCQDMISALCKNKTLKSLDLSFNSLKDDGVILLCEALKNPDCTLQILELENCLFTSICCQAMASMLRKNQHLRHLDLSKNAIGVYGILTLCEAFSSQKKREEVIFCIPAWTRITSFSPTPHPPDFTGKSDCLSQINP

SEQ ID NO: 9103 - RNA, 3147 nt, Artificial Sequence
  NALP8__Homo_sapiens__DAA01242
augagugacgugaauccacccucugacacccccauucccuuuucauccuccuccacucacaguucucauauuccgcccuggacauucucuugcuaccccggcuccccaugugaaaauggggucaugcuguacaugagaaacgugagccaugaggagcuacaacgguucaagcagcucuuacugacugagcucaguacuggcaccaugcccaucaccugggaccaggucgagacagccagcugggcagaggugguucaucucuugauagagcguuucccuggacgacgcgcuugggaugugacuucgaacaucuuugccauuaugaacugugauaaaauguguguuguaguccgcagagagauaaaugccauucugccuaccuuggaaccagaggacuugaaugugggagaaacacaggugaaucuggaggaaggagaaucugguaaaauacggcgguauaaaucgaaugugauggaaaaguuuuuccccauaugggacauuacgacuuggccuggaaaccagagggacuucuucuaccaagguguacacaggcacgaggaguacuuaccaugucugcuucugcccaaaagaccccaggguagacagcccaagaccguggccauacagggagcuccugggaucggaaaaacaauccuggccaaaaaggugauguuugagugggccagaaacaaguucuacgcccacaagcgcuggugugcuuucuacuuccauugccaagaggugaaccagacgacagaccagagcuucuccgagcugauugagcaaaaguggccuggaucucaggaccucgugucaaagauuauguccaaacccgaccaacuucugcugcucuuggauggcuuugaggagcucacaucuacccucauugacagacuggaggaccugagugaagacuggaggcagaaauugccugggucuguccuacugagcaguuugcugagcaaaacgaugcuuccagaggccacgcuacugaucaugauaagauuuaccucuuggcagacaugcaagcccuugcugaaaugucccucucucguaacccuuccgggguuuaauacgauggaaaaaaucaaguauuuccagauguauuuuggacacacagaggagggagaccaagucuugaguuucgccauggaaaacaccauucucuucuccaugugccgggucccugugguuugcuggauggucugcucuggucugaaacagcaaauggagagaggaaacaaucucacacagucauguccaaaugccaccucuguguucguccgguauauuucuagcuuguuucccaccagagcugagaacuuuuccagaaagauccaccaagcacaacuggaaggucugugucacuuggccgcagacagcauguggcacaggaaauggguguuagguaaagaagaucuugaggaagccaagcuggaucagacgggagucaccgccuuccuuggcaugaguauucuucggagaauugcaggugaggaagaccacuaugucuuuacccucgugacuuuucaggaauuuuuugcggccuuguuuuauguucucuguuucccacaaagacucaaaaauuuucauguguugagccacgugaauauccagcgccugauagcgagucccagaggaagcaaaagcuaucucucucacaugggacuuuucuuauucgguuuucugaacgaggccugcgcuucggccguggaacagucauuccaaugcaaggugucuuucgguaauaagaggaaacugcugaaagucauaccucuguugcauaaaugugacccaccuucuccgggcaguggggucccgcaguuauucuacugucugcaugaaauccgggaggaagccuuuguaagccaagcccuaaaugauuaucauaaaguugucuugagaauuggcaacaacaaagaaguucaagugucugcuuuuugccugaagcggugucaauauuugcaugagguggaacugaccgucacccugaacuucaugaacguguggaagcucagcuccagcucccauccuggcucugaagcgccagagagcaaugggcugcaucguugguggcaagacuuaugcucuguguuugcaacgaaugauaagcuggaaguccugacuaugaccaacaguguuuuggggccuccuuuuuugaaggcucucgcggccgcacugaggcacccucagugcaaacugcaaaagcuacuccuaaggcgugugaauagcaccauguugaaccaggacuuaaucgguguuuugacggggaaccagcaucugagauacuuggaaauacaacauguggaaguggaguccaaagcugugaagcuucuaugcagggugcugagauccccccggugccgucugcagugucucagguuggaagacugcuuggccaccccuagaauuuggacugaucuuggcaauaaucuucaagguaacgggcaucuaaagacucucauacuaagaaaaaacucccuggagaacuguggggcguauuaccugucuguggcccagcuggagaggcugucgauagagaacugcaaccuuacacagcuuacuugugaaagccuugccuccugucucaggcagaguaagaugcugacccaccugagcuuggcagaaaacgccuugaaagaugaaggggccaagcauauuuggaaugcccugccacaccugagauguccucugcagaggcugguacugagaaagugugacuugaccuuuaauugcugucaggauaugaucucugcgcucuguaaaaauaaaacccugaaaagucuugaccuaaguuuuaauagccugaaggaugauggggugauccugcugugugaggcccugaagaacccugacuguacauuacagauccuggagcuggaaaacugccuguucaccuccaucugcugccaggccauggcuuccaugcuccgcaaaaaccaacaucugagacaucuggacuugagcaagaaugcgauuggagucuaugguauucugaccuugugcgaggccuucucaagccaaaagaagagagaagaggucauuuucuguauuccugccuggacucgaauaacuagcuucuccccaacuccucacccacccgacuucacgggaaaaagugacugccuaucccagauuaauccuuag

SEQ ID NO: 9104 - RNA, 3147 nt, Artificial Sequence
  derived and/or modified sequence opt1 from NALP8__Homo_sapiens__DAA01242
augagcgacgugaacccgcccuccgacacccccauccccuucagcuccagcuccacccacagcucccacaucccgcccuggacguucagcugcuaccccggcucccccugcgagaacggggucaugcuguacaugcgcaacgugagccacgaggagcuccagcgguucaagcagcugcugcucaccgagcuguccaccggcaccaugcccaucacgugggaccagguggagaccgccagcugggccgaggucgugcaccuccucaucgagcgcuuccccgggcggcgcgcgugggacgugaccuccaacaucuucgccaucaugaacugcgacaagaugugcgucguggugcggcgcgagaucaacgccauccugcccacccuggagcccgaggaccucaacgucggcgagacccaggugaaccuggaggagggggagagcggcaagauccggcgcuacaaguccaacgugauggagaaguucuuccccaucugggacaucaccaccuggccgggcaaccagcgggacuucuucuaccaggggguccaccgccacgaggaguaccugcccugccuccugcugcccaagcggccccagggccgccagccgaagaccguggccauccagggggcccccggcaucgggaagacgauccucgcgaagaaggugauguucgagugggcccggaacaaguucuacgcccacaagcgcuggugcgccuucuacuuccacugccaggaggucaaccagaccaccgaccagagcuucuccgagcugaucgagcagaaguggcccggcagccaggaccugguguccaagaucaugagcaagcccgaccagcuccugcugcuccuggacggcuucgaggagcugaccagcacgcucaucgaccggcuggaggaccuguccgaggacuggcgccagaagcucccggggagcgugcugcuguccagccuccuguccaagaccaugcugcccgaggcgacccuccugaucaugauccgguucaccagcuggcagacgugcaagccccugcucaagugccccucccuggucacccugccgggcuucaacaccauggagaagaucaaguacuuccagauguacuucgggcacaccgaggagggcgaccaggugcucagcuucgccauggagaacacgauccuguucuccaugugccgcgugcccgucgugugcuggauggugugcagcggccugaagcagcagauggagcgggggaacaaccucacccaguccugccccaacgccaccagcgucuucgugcgcuacaucuccagccuguuccccacccgggccgagaacuucucccgcaagauccaccaggcccagcuggagggccucugccaccuggcggccgacagcauguggcaccgcaaguggguccuggggaaggaggaccucgaggaggccaagcuggaccagacgggcgugaccgccuuccuggggauguccauccugcggcgcaucgccggcgaggaggaccacuacguguucacccucgucaccuuccaggaguucuucgcggcccuguucuacgugcugugcuucccgcagcggcucaagaacuuccacgugcugagccacgucaacauccagcgccugaucgccagcccccggggcuccaagagcuaccucucccacauggggcuguuccuguucggcuuccucaacgaggccugcgccagcgcgguggagcaguccuuccagugcaaggugagcuucgggaacaagcgcaagcugcugaaggucaucccccuccugcacaagugcgacccgcccucccccggcagcggggugccccagcuguucuacugccuccacgagauccgggaggaggccuucgugucccaggcccugaacgacuaccacaaggucgugcugcgcaucggcaacaacaaggaggugcaggucagcgccuucugccucaagcggugccaguaccugcacgagguggagcugacggugacccucaacuucaugaacgucuggaagcuguccagcuccagccacccgggcuccgaggcccccgagagcaacgggcugcaccgcugguggcaggaccucugcuccguguucgcgaccaacgacaagcuggaggugcugaccaugacgaacagcguccucggcccgcccuuccugaaggcccuggccgccgcgcuccggcacccccagugcaagcugcagaagcugcuccugcgccgggugaacuccaccaugcugaaccaggaccucaucggggugcugaccggcaaccagcaccuccgcuaccuggagauccagcacgucgagguggagagcaaggccgugaagcugcugugccggguccuccgcagcccccggugccgccugcagugccugcggcucgaggacugccuggccacgccccgcaucuggaccgaccuggggaacaaccuccagggcaacggccaccugaagacgcugauccuccgcaagaacucccuggagaacugcggggccuacuaccugagcguggcccagcucgagcggcuguccaucgagaacugcaaccugacccagcugaccugcgagagccuggcguccugccugcgccagagcaagaugcucacccaccugucccuggccgagaacgcccucaaggacgagggcgccaagcacaucuggaacgcccugccccaccuccggugcccgcugcagcgccuggugcugcggaagugcgaccucacguucaacugcugccaggacaugaucagcgcgcugugcaagaacaagacccugaagucccucgaccugagcuucaacucccugaaggacgacggggucauccuccugugcgaggcccugaagaaccccgacugcacccuccagauccuggagcuggagaacugccucuucaccagcaucugcugccaggccauggccuccaugcugcgcaagaaccagcaccuccggcaccuggaccugagcaagaacgccaucggcguguacggcauccugacgcucugcgaggcguucuccagccagaagaagcgcgaggaggugaucuucugcauccccgccuggacccggaucaccuccuucagccccaccccgcacccgcccgacuucacggggaaguccgacugccugagccagaucaaccccuga

SEQ ID NO: 9105 - RNA, 3147 nt, Artificial Sequence
  derived and/or modified sequence opt2 from NALP8__Homo_sapiens__DAA01242
auguccgacgucaacccccccuccgacacccccauccccuucuccuccuccuccacccacuccucccacaucccccccuggaccuucuccugcuaccccggcucccccugcgagaacggcgucaugcucuacaugcgcaacgucucccacgaggagcuccagcgcuucaagcagcuccuccucaccgagcucuccaccggcaccaugcccaucaccugggaccaggucgagaccgccuccugggccgaggucguccaccuccucaucgagcgcuuccccggccgccgcgccugggacgucaccuccaacaucuucgccaucaugaacugcgacaagaugugcgucgucguccgccgcgagaucaacgccauccuccccacccucgagcccgaggaccucaacgucggcgagacccaggucaaccucgaggagggcgaguccggcaagauccgccgcuacaaguccaacgucauggagaaguucuuccccaucugggacaucaccaccuggcccggcaaccagcgcgacuucuucuaccagggcguccaccgccacgaggaguaccuccccugccuccuccuccccaagcgcccccagggccgccagcccaagaccgucgccauccagggcgcccccggcaucggcaagaccauccucgccaagaaggucauguucgagugggcccgcaacaaguucuacgcccacaagcgcuggugcgccuucuacuuccacugccaggaggucaaccagaccaccgaccaguccuucuccgagcucaucgagcagaaguggcccggcucccaggaccucgucuccaagaucauguccaagcccgaccagcuccuccuccuccucgacggcuucgaggagcucaccuccacccucaucgaccgccucgaggaccucuccgaggacuggcgccagaagcuccccggcuccguccuccucuccucccuccucuccaagaccaugcuccccgaggccacccuccucaucaugauccgcuucaccuccuggcagaccugcaagccccuccucaagugccccucccucgucacccuccccggcuucaacaccauggagaagaucaaguacuuccagauguacuucggccacaccgaggagggcgaccagguccucuccuucgccauggagaacaccauccucuucuccaugugccgcguccccgucgucugcuggauggucugcuccggccucaagcagcagauggagcgcggcaacaaccucacccaguccugccccaacgccaccuccgucuucguccgcuacaucuccucccucuuccccacccgcgccgagaacuucucccgcaagauccaccaggcccagcucgagggccucugccaccucgccgccgacuccauguggcaccgcaaguggguccucggcaaggaggaccucgaggaggccaagcucgaccagaccggcgucaccgccuuccucggcauguccauccuccgccgcaucgccggcgaggaggaccacuacgucuucacccucgucaccuuccaggaguucuucgccgcccucuucuacguccucugcuucccccagcgccucaagaacuuccacguccucucccacgucaacauccagcgccucaucgccuccccccgcggcuccaaguccuaccucucccacaugggccucuuccucuucggcuuccucaacgaggccugcgccuccgccgucgagcaguccuuccagugcaaggucuccuucggcaacaagcgcaagcuccucaaggucaucccccuccuccacaagugcgacccccccucccccggcuccggcgucccccagcucuucuacugccuccacgagauccgcgaggaggccuucgucucccaggcccucaacgacuaccacaaggucguccuccgcaucggcaacaacaaggagguccaggucuccgccuucugccucaagcgcugccaguaccuccacgaggucgagcucaccgucacccucaacuucaugaacgucuggaagcucuccuccuccucccaccccggcuccgaggcccccgaguccaacggccuccaccgcugguggcaggaccucugcuccgucuucgccaccaacgacaagcucgagguccucaccaugaccaacuccguccucggcccccccuuccucaaggcccucgccgccgcccuccgccacccccagugcaagcuccagaagcuccuccuccgccgcgucaacuccaccaugcucaaccaggaccucaucggcguccucaccggcaaccagcaccuccgcuaccucgagauccagcacgucgaggucgaguccaaggccgucaagcuccucugccgcguccuccgcuccccccgcugccgccuccagugccuccgccucgaggacugccucgccaccccccgcaucuggaccgaccucggcaacaaccuccagggcaacggccaccucaagacccucauccuccgcaagaacucccucgagaacugcggcgccuacuaccucuccgucgcccagcucgagcgccucuccaucgagaacugcaaccucacccagcucaccugcgagucccucgccuccugccuccgccaguccaagaugcucacccaccucucccucgccgagaacgcccucaaggacgagggcgccaagcacaucuggaacgcccucccccaccuccgcugcccccuccagcgccucguccuccgcaagugcgaccucaccuucaacugcugccaggacaugaucuccgcccucugcaagaacaagacccucaagucccucgaccucuccuucaacucccucaaggacgacggcgucauccuccucugcgaggcccucaagaaccccgacugcacccuccagauccucgagcucgagaacugccucuucaccuccaucugcugccaggccauggccuccaugcuccgcaagaaccagcaccuccgccaccucgaccucuccaagaacgccaucggcgucuacggcauccucacccucugcgaggccuucuccucccagaagaagcgcgaggaggucaucuucugcauccccgccuggacccgcaucaccuccuucucccccaccccccacccccccgacuucaccggcaaguccgacugccucucccagaucaaccccuga

SEQ ID NO: 9106 - RNA, 3147 nt, Artificial Sequence
  derived and/or modified sequence opt3 from NALP8__Homo_sapiens__DAA01242
augagcgacgugaaucccccuuccgauaccccaaucccguucucuucaaguagcacacacuccucucauauucccccuuggacuuuuucgugcuacccaggcucacccugugagaacggggucaugcuguauaugagaaacguuagccacgaggaacuccagagguucaagcaacuucuguugacggaauuaaguaccggaacaaugccuauaacuugggaccagguggagaccgccuccugggcugaaguagugcaucugcuaaucgagcgguuuccaggucgccgagcaugggaugucacaucuaauauuuucgccaucaugaacugcgacaaaaugugugugguugugcguagagagauuaaugcgauccuccccacccuggaaccugaggaucuuaacgucggcgaaacucaggugaaucuggaggagggggaaagcggaaagauaaggcgguacaaauccaacguaauggagaaguuuuucccaaucugggacauuacaaccuggccgggcaaucagcgcgacuuuuucuaucaagguguucacagacaugaagaguacuugcccugccuccugcugccuaaaaggccacaggggcggcagcccaagacgguggcuauccagggagccccuggcauuggcaagacuauccucgcaaagaaggucauguuugaaugggcccgcaacaaauucuaugcucacaagcgauggugugcauuuuacuuccacugccaagaggugaaucagaccacagaucagucauuuagugaguuaauagaacagaaauggccagggagccaagaucuggugucuaagauuauguccaagcccgaccagcuuuugcugcuacucgauggauucgaggaacugacuucaacccuuaucgacagacuggaggauuugagcgaagacuggaggcagaaacucccggguaguguccuguuaucuucccugcucagcaagacaaugcuuccugaggccacccuguugauuaugauccgguucacgucguggcaaacuuguaaaccccuacugaagugcccaucucucguuacacugccuggcuuuaacaccauggagaaaaucaaguauuuccagauguacuuugggcauacugaagagggagaccaggugcuuuccuucgcuauggaaaauacaauucuguuuucaaugugucguguacccguggucugcuggaugguguguaguggcuugaaacagcaaauggagcgcgguaacaaucucacccagagcugcccaaacgccacguccguuuucgugagauacauaucuagccuguuucccaccagggcggaaaacuucucacggaagauccaccaggcacaguuagaggggcugugccaucuagccgcugauaguauguggcaccgaaaguggguccucggaaaagaggaccuggaagaggccaaacuugaucaaacaggcgugacugcauuuuugggcauguccauucugcgcagaaucgcuggggaagaggaccacuauguauucacccucguuacauuucaggaguucuuugccgcgcuguucuacgugcuuuguuucccucagaggcugaaaaauuuucaugucuugagccacgugaacauacagcggcucauugccucuccacgcggaucaaagaguuaucugagccauauggguuuauuccuguuuggcuuccuaaaugaagcaugcgcuuccgccgucgagcaaucuuuucaguguaaagugucguucgggaacaagagaaagcuccugaaaguuaucccgcuuuugcacaagugcgaucccccuagcccaggauccggcgugccccagcuguuuuacugucuccaugaaaucagggaggaggcuuucguaucacaggcccugaaugacuaucacaaagucguguuacguauugguaacaauaaggaaguucaagugagugcauuuugccugaaacggugucaguaccuucacgaggucgaauugacugugacccucaacuucaugaauguauggaagcugucuagcuccucacauccugggagcgaggccccagaaucuaacggccuacaccgaugguggcaggaucugugcuccguguuugcuacaaaugacaagcucgagguucugaccaugacuaacaguguccuuggacccccguucuugaaagcgcuggcagccgcuuuaagacauccucaauguaagcuccagaaacugcuucugaggcgcgugaauagcacgauguugaaccaggaucucaucggcgugcugacagggaaucagcaccuacgguaucuggaaauucaacacgucgagguugagucuaaggccgugaaacuccugugcagagugcuuagguccccacgcugucgauugcagugccugcgguuagaagacugccucgcaacuccccguauauggaccgaucugggaaacaaccuucaggguaauggccaucugaagacccuaauccucagaaagaacucacuggagaauuguggggccuacuacuugaguguagcucagcuggaaagguuaagcauugagaacugcaaucucacacaacugaccugugaaucgcuugccuccugccugcgccagucuaaaauguugacucaccucagccuggcagagaacgcgcuaaaggacgagggagcuaaacauaucuggaaugcccugccucaccuucgguguccccuccagagacuggucuugaggaagugcgaccugacauuuaacuguugccaggauaugaucucagcauuauguaaaaauaagacgcucaaaagucuggaccuuuccuucaacucucugaaggaugacggcgugauuuugcucugcgaagcccugaagaauccagauuguacccuacaaauacuggagcuugaaaacugccucuucacuagcaucugcugucaggcuauggccuccaugcugcgcaaaaaucagcauuugcgacacuuagaccugucaaagaacgcaauugguguuuaugggauccucacacugugcgaggcuuuuagcagucagaaaaagcgggaggaagugauuuucuguaucccugccuggaccagaauaacaucuuuuucccccacuccacacccgccugauuucaccggcaaaagcgacugccuuucgcaaaucaaucccuga

SEQ ID NO: 9107 - RNA, 3147 nt, Artificial Sequence
  derived and/or modified sequence opt4 from NALP8__Homo_sapiens__DAA01242
augagcgacgugaacccccccagcgacacccccauccccuucagcagcagcagcacccacagcagccacaucccccccuggaccuucagcugcuaccccggcagccccugcgagaacggcgugaugcuguacaugagaaacgugagccacgaggagcugcagagauucaagcagcugcugcugaccgagcugagcaccggcaccaugcccaucaccugggaccagguggagaccgccagcugggccgagguggugcaccugcugaucgagagauuccccggcagaagagccugggacgugaccagcaacaucuucgccaucaugaacugcgacaagaugugcgugguggugagaagagagaucaacgccauccugcccacccuggagcccgaggaccugaacgugggcgagacccaggugaaccuggaggagggcgagagcggcaagaucagaagauacaagagcaacgugauggagaaguucuuccccaucugggacaucaccaccuggcccggcaaccagagagacuucuucuaccagggcgugcacagacacgaggaguaccugcccugccugcugcugcccaagagaccccagggcagacagcccaagaccguggccauccagggcgcccccggcaucggcaagaccauccuggccaagaaggugauguucgagugggccagaaacaaguucuacgcccacaagagauggugcgccuucuacuuccacugccaggaggugaaccagaccaccgaccagagcuucagcgagcugaucgagcagaaguggcccggcagccaggaccuggugagcaagaucaugagcaagcccgaccagcugcugcugcugcuggacggcuucgaggagcugaccagcacccugaucgacagacuggaggaccugagcgaggacuggagacagaagcugcccggcagcgugcugcugagcagccugcugagcaagaccaugcugcccgaggccacccugcugaucaugaucagauucaccagcuggcagaccugcaagccccugcugaagugccccagccuggugacccugcccggcuucaacaccauggagaagaucaaguacuuccagauguacuucggccacaccgaggagggcgaccaggugcugagcuucgccauggagaacaccauccuguucagcaugugcagagugcccguggugugcuggauggugugcagcggccugaagcagcagauggagagaggcaacaaccugacccagagcugccccaacgccaccagcguguucgugagauacaucagcagccuguuccccaccagagccgagaacuucagcagaaagauccaccaggcccagcuggagggccugugccaccuggccgccgacagcauguggcacagaaagugggugcugggcaaggaggaccuggaggaggccaagcuggaccagaccggcgugaccgccuuccugggcaugagcauccugagaagaaucgccggcgaggaggaccacuacguguucacccuggugaccuuccaggaguucuucgccgcccuguucuacgugcugugcuucccccagagacugaagaacuuccacgugcugagccacgugaacauccagagacugaucgccagccccagaggcagcaagagcuaccugagccacaugggccuguuccuguucggcuuccugaacgaggccugcgccagcgccguggagcagagcuuccagugcaaggugagcuucggcaacaagagaaagcugcugaaggugaucccccugcugcacaagugcgacccccccagccccggcagcggcgugccccagcuguucuacugccugcacgagaucagagaggaggccuucgugagccaggcccugaacgacuaccacaagguggugcugagaaucggcaacaacaaggaggugcaggugagcgccuucugccugaagagaugccaguaccugcacgagguggagcugaccgugacccugaacuucaugaacguguggaagcugagcagcagcagccaccccggcagcgaggcccccgagagcaacggccugcacagaugguggcaggaccugugcagcguguucgccaccaacgacaagcuggaggugcugaccaugaccaacagcgugcugggcccccccuuccugaaggcccuggccgccgcccugagacacccccagugcaagcugcagaagcugcugcugagaagagugaacagcaccaugcugaaccaggaccugaucggcgugcugaccggcaaccagcaccugagauaccuggagauccagcacguggagguggagagcaaggccgugaagcugcugugcagagugcugagaagccccagaugcagacugcagugccugagacuggaggacugccuggccacccccagaaucuggaccgaccugggcaacaaccugcagggcaacggccaccugaagacccugauccugagaaagaacagccuggagaacugcggcgccuacuaccugagcguggcccagcuggagagacugagcaucgagaacugcaaccugacccagcugaccugcgagagccuggccagcugccugagacagagcaagaugcugacccaccugagccuggccgagaacgcccugaaggacgagggcgccaagcacaucuggaacgcccugccccaccugagaugcccccugcagagacuggugcugagaaagugcgaccugaccuucaacugcugccaggacaugaucagcgcccugugcaagaacaagacccugaagagccuggaccugagcuucaacagccugaaggacgacggcgugauccugcugugcgaggcccugaagaaccccgacugcacccugcagauccuggagcuggagaacugccuguucaccagcaucugcugccaggccauggccagcaugcugagaaagaaccagcaccugagacaccuggaccugagcaagaacgccaucggcguguacggcauccugacccugugcgaggccuucagcagccagaagaagagagaggaggugaucuucugcauccccgccuggaccagaaucaccagcuucagccccaccccccacccccccgacuucaccggcaagagcgacugccugagccagaucaaccccuga

SEQ ID NO: 9108 - RNA, 3147 nt, Artificial Sequence
  derived and/or modified sequence opt5 from NALP8__Homo_sapiens__DAA01242
augagcgacgugaaucccccuuccgauaccccgauccccuucucuagcuccucuacacacagcucccauauuccucccuggacguuuucuugcuacccuggcagccccugugagaacggggucaugcuguauaugagaaacguuucccacgaggaacuccagcgguucaagcaacugcuucugaccgaacucagcacaggaaccaugccuaucacaugggaccagguggagaccgccucuugggcugaagugguccaucugcuuauugagcgcuuuccgggcagacgggccugggaugugacauccaauaucuucgcgauuaugaacugcgacaaaauguguguugugguccgcagagagaucaaugcuauccugcccacccucgaaccugaggaucugaacgugggggaaacgcagguuaaucuggaggagggagaaagcggcaagauucggcgcuacaaaucuaacgugauggagaaguuuuuccccaucugggacauuaccacauggccugggaaucagagagacuuuuucuaucaaggaguccaccggcaugaagaguaccuccccugccugcuucugccgaaacgcccucagggcagacagcccaagaccguggccauccagggcgccccugggauuggaaagacaauccucgcuaaaaaggugauguuugaaugggcccggaacaaauucuaugcucacaagcgcuggugugccuuuuacuuccacugccaagaggucaaucagaccacggaucaguccuuuagcgagcugauugaacagaaauggcccggcucucaagaucuuguuuccaagaucaugagcaagcccgaccagcugcuccugcugcucgauggguucgaggaacugacauccacccuuaucgacagacuggaggaucucucugaagacuggcggcagaaacugccuggaagcgugcuucuguccagccuccugucuaagacaaugcugccggaggcgacccuccugauuaugauccgcuucaccuccuggcaaacauguaaaccccuucugaagugcccuagccucgugacgcugcccggcuuuaacaccauggagaaaauuaaguauuuccagauguacuuugggcauacagaagagggagaccagguccuuucuuucgccauggaaaauaccauccuguuuagcauguguagagugccuguugugugcuggauggucuguuccggccucaaacagcaaauggagcggggcaacaaucugacacagucuugccccaacgcuaccagcguguucguuagauacauuuccagccuguuuccgacgcgcgccgaaaacuucucucggaagauccaccaggcucagcucgaggggcugugccaucuugccgcggauuccauguggcacagaaagugggugcugggaaaagaggaccucgaagaggccaagcuggaucaaacaggcgucaccgcuuuucuggggaugagcauccuucgccggauugccggagaagaggaccacuauguguucacccucgucacauuucaggaguucuuugcugcccuguucuacgugcuguguuucccucagagacucaaaaauuuucauguucugucucacgugaacauccagcgccuuauugccagcccccggggcagcaaguccuaucugucucauaugggacucuuccuguuuggguuccugaaugaggcuugcgcgagcgccgucgaacaauccuuucaguguaaagugucuuucggcaacaagagaaaacuucucaaaguuaucccucugcugcacaagugcgaucccccuagccccggcuccggggugccgcagcucuuuuacugucugcaugaaauucgcgaggaggcuuucgucagccaggcccuuaaugacuaucacaaaguggugcugcggaucggaaacaauaaggaaguucaagucucugccuuuugccucaaaagaugucaguaccugcacgagguggaacugaccgugacacuuaacuucaugaaugucuggaagcucuccuccucuucccauccuggcagcgaggcucccgaaucuaacgggcugcaccgcugguggcaggaucugugcagcguguuugccacgaaugacaagcucgagguucugaccaugacaaacuccgugcuuggacccccuuuccugaaagcgcucgcugccgcccugcggcauccgcaauguaagcugcagaaacuucuccugagacgggucaauagcaccaugcugaaccaggaucucaucggcgugcugacagggaaucagcaccuucgcuaucuggaaauucaacacguugagguggagucuaaggcugucaaacuccugugcagagugcugcggucccccagaugucgccuucagugccugcggcucgaagacugccuggccaccccuagaaucuggacggaucucggcaacaaccugcagggaaauggccaucuuaagacccugauucuccgcaagaacagccuggagaauuguggggcuuacuaccuguccguugcccagcuugaaagacugucuaucgagaacugcaaucucacacaacugaccugugaaagccucgcguccugccugcggcagucuaaaaugcuuacacaccugagccucgccgagaacgcucugaaggacgagggagccaaacauauuuggaaugcucugccccaccuucgcuguccucugcagagacucgugcugcggaagugcgaccucaccuuuaacuguugccaggauaugaucuccgcccuguguaaaaauaagacgcuuaaaucucuggaccugagcuucaacucccucaaggaugacggcgucauucugcuuugcgaagcgcugaagaaucccgauuguacacuccaaauccuggagcucgaaaacugccuguucaccagcaucugcugucaggccauggcuucuaugcuucgcaaaaaucagcaucugagacaccuggaccucuccaagaacgccauugggguguauggaauccugacacuuugcgaggcuuuuagcucucaaaagaagcgggaggaagugauuuucuguaucccugccuggacccgcauuaccuccuuuagccccacaccgcacccucccgauuucacgggcaaaucugacugccugucccagaucaauccuuga

SEQ ID NO: 9109 - protein, 991 aa, Artificial Sequence
  NALP9__Homo_sapiens__Q7RTR0
MAESFFSDFGLLWYLKELRKEEFWKFKELLKQPLEKFELKPIPWAELKKASKEDVAKLLDKHYPGKQAWEVTLNLFLQINRKDLWTKAQEEMRNKLNPYRKHMKETFQLIWEKETCLHVPEHFYKETMKNEYKELNDAYTAAARRHTVVLEGPDGIGKTTLLRKVMLDWAEGNLWKDRFTFVFFLNVCEMNGIAETSLLELLSRDWPESSEKIEDIFSQPERILFIMDGFEQLKFNLQLKADLSDDWRQRQPMPIILSSLLQKKMLPESSLLIALGKLAMQKHYFMLRHPKLIKLLGFSESEKKSYFSYFFGEKSKALKVFNFVRDNGPLFILCHNPFTCWLVCTCVKQRLERGEDLEINSQNTTYLYASFLTTVFKAGSQSFPPKVNRARLKSLCALAAEGIWTYTFVFSHGDLRRNGLSESEGVMWVGMRLLQRRGDCFAFMHLCIQEFCAAMFYLLKRPKDDPNPAIGSITQLVRASVVQPQTLLTQVGIFMFGISTEEIVSMLETSFGFPLSKDLKQEITQCLESLSQCEADREAIAFQELFIGLFETQEKEFVTKVMNFFEEVFIYIGNIEHLVIASFCLKHCQHLTTLRMCVENIFPDDSGCISDYNEKLVYWRELCSMFITNKNFQILDMENTSLDDPSLAILCKALAQPVCKLRKLIFTSVYFGHDSELFKAVLHNPHLKLLSLYGTSLSQSDIRHLCETLKHPMCKIEELILGKCDISSEVCEDIASVLACNSKLKHLSLVENPLRDEGMTLLCEALKHSHCALERLMLMYCCLTSVSCDSISEVLLCSKSLSLLDLGSNALEDNGVASLCAALKHPGCSIRELWLMGCFLTSDSCKDIAAVLICNGKLKTLKLGHNEIGDTGVRQLCAALQHPHCKLECLGLQTCPITRACCDDIAAALIACKTLRSLNLDWIALDADAVVVLCEALSHPDCALQMLGLHKSGFDEETQKILMSVEEKIPHLTISHGPWIDEEYKIRGVLL

SEQ ID NO: 9110 - RNA, 2976 nt, Artificial Sequence
  NALP9__Homo_sapiens__AAI36584
auggcagaaucuuuuuuuucggauuuuggcuuguugugguaucugaaggagcucagaaaggaagaguuuuggaaauuuaaggagcuccucaaacaaccuuuggagaaauuugaacucaagccaauccccugggcugagcugaagaaggccuccaaagaagauguagcaaagcugcuggacaaacauuacccaggaaagcaggcaugggagguaacacugaaccuguuucuacagaucaauaggaaagaucucuggacaaaggcucaggaagagaugagaaauaagcuaaacccauacagaaagcauaugaaggaaacauuucaacucauaugggagaaggaaaccugucuucacgucccugagcauuucuacaaagaaaccaugaaaaaugaguauaaagaauugaaugacgcauauacugcugcggcuagacgacacacugugguccuggaagguccugauggaauuggaaaaacaacccuuuuaagaaaagugauguuggacugggcagagggaaacuuauggaaggacagguucacauuuguguuuuuccucaaugucugugaaaugaacgguaucgcagagaccagcuuacuggagcuccucucuagggacuggccggagucuucagagaagaucgaagacauuuuuucccagccagagagaauucuguucaucauggauggcuuugagcaacugaaguuuaacuuacaacuuaaggcugacuugagcgaugauuggaggcagcggcagccaaugccaauuauccugagcaguuuguugcaaaaaaagaugcuuccagaauccucucuccuuauugcauuaggaaaacuggcuaugcaaaaacacuauuuuauguugcggcauccaaaacucauaaagcucuuaggauucagugaaucugaaaagaagucguauuucuccuacuucuuuggugagaagagcaaagcccugaaagucuucaauuuugugagagauaaugggccgcuguuuaucuugugccauaaucccuuuacgugcugguuggucuguacuugugugaaacagaggcuagagaggggagaagaccuugaaauaaacucccaaaacaccaccuauuuauaugcauccuuuuuaacaacuguauucaaagcaggaagucagaguuuuccaccuaaggugaacagagcccgacuaaaaagccugugugcuuuggcugcagagggaauuuggacauauacauuuguauuuucccauggggaucuccggaggaauggguuaucugagucugagggcgugauguggguggguaugagacuccuccaaaggagaggggacuguuuugccuucaugcaucuguguauccaagaguuuugugccgccauguuuuauuugcucaaacgacccaaagacgauccuaacccggccauuggaagcauaacccagcuuguaagagcaagugugguucagccucaaacccucuugacccagguggggauauucauguuuggaauuucaacagaagaaaucgucagcaugcuggagaccuccuuugguuuuccacugucaaaagaccuaaagcaggaaauaacccaaugccuugaaaguuuaagucaaugugaagcugauagggaagccauagcuuuccaggaacuauucauugguuuguuugaaacucaggaaaaagaauuuguaaccaaagugaugaauuucuuugaagaaguuuucauuuauauugguaacauagaacauuugguaauagcuucauucugccugaagcauugucaacauuuaacgacacuucgcauguguguggagaauaucuuuccagaugacucaggaugcaucucagauuacaaugagaagcucgucuacuggcgggagcuuugcucaauguucauuaccaacaagaacuuccagauuuuagacauggaaaauaccagccucgaugaucccucccuggcgauucuuugcaaagcgcuggcucagccuguuuguaaacuccgaaaacucauauuuacuucuguguacuuuggacaugauucagaauuauuuaaggcaguucuucacaacccucaucugaaacuucugagccuguacggcacuagccucucccagucugacaucagacaccugugugagacgcugaaacauccaaugugcaagauagaagagcugauacugggaaagugugacaucuccagugaaguuugugaagacaucgccuccguccuggccugcaacagcaagcugaaacaccucuccuugguagaaaaucccuugagggacgaaggaaugacguugcugugugaagcccugaagcacucacacugugcccuggagaggcugauguugauguacugcugucucaccucugucuccugugacuccauuuccgaaguccucuugugcaguaagucccugucccuccucgaucugggcucaaaugcccuggaagauaauggaguggcaucucugugugcagcgcugaagcacccaggcugcagcauacgggagcugugguugaugggcuguuuccuuacuuccgauuccuguaaggacauugcugcuguucuuauuugcaaugggaaacugaagacccugaaacuugggcauaaugaaauaggagacacuggugucagacaguuaugugcagcuuugcagcauccucacuguaaauuagagugucucgggcugcaaacguguccgaucacccgugccugcugcgacgacaucgccgcagcacucaucgccugcaaaacacugaggagccugaaccucgacuggauugccuuggaugcugaugcagugguggugcugugugaggcauugagccacccggacugugcccugcagaugcuggggcugcacaaaucuggcuuugaugaagaaacucagaagauccugaugucuguggaagaaaaaauuccccaucugaccauuucacauggaccuuggauugacgaggaauacaagaucaggggugugcuccucuga

SEQ ID NO: 9111 - RNA, 2976 nt, Artificial Sequence
  derived and/or modified sequence opt1 from NALP9__Homo_sapiens__AAI36584
auggccgagagcuucuucuccgacuucggccugcucugguaccugaaggagcugcggaaggaggaguucuggaaguucaaggagcuccugaagcagccccuggagaaguucgagcucaagccgauccccugggccgagcugaagaaggcgagcaaggaggacguggccaagcugcucgacaagcacuaccccgggaagcaggccugggaggucacccugaaccuguuccuccagaucaaccggaaggaccuguggaccaaggcccaggaggagaugcgcaacaagcugaaccccuaccggaagcacaugaaggagacguuccagcucaucugggagaaggagaccugccugcacgugccggagcacuucuacaaggagaccaugaagaacgaguacaaggagcugaacgacgccuacaccgcggccgcccgccggcacacggugguccucgagggccccgacgggaucggcaagaccacccugcugcgcaaggugaugcucgacugggccgaggggaaccuguggaaggaccgguucaccuucguguucuuccugaacgucugcgagaugaacggcaucgcggagacgucccuccuggagcugcucagccgcgacuggcccgaguccagcgagaagaucgaggacaucuucucccagcccgagcggauccuguucaucauggacggcuucgagcagcugaaguucaaccuccagcugaaggccgaccugagcgacgacuggcgccagcggcagccgaugcccaucauccucuccagccugcugcagaagaagaugcuccccgaguccagccugcugaucgcccucgggaagcuggccaugcagaagcacuacuucaugcugcgccaccccaagcucaucaagcugcugggcuucuccgagagcgagaagaaguccuacuucagcuacuucuucggggagaaguccaaggcccucaagguguucaacuucgugcgggacaacggcccgcuguucauccugugccacaaccccuucacgugcuggcucgucugcacgugcgugaagcagcgccuggagcgcggggaggaccuggagaucaacagccagaacaccaccuaccuguacgcguccuuccucaccaccguguucaaggccggcagccagagcuucccgcccaaggucaaccgggcccggcugaagucccugugcgcccucgccgcggagggcaucuggaccuacaccuucguguucagccacggggaccugcgccggaacggccuguccgagagcgagggggugaugugggucggcaugcgccuccugcagcggcgcggcgacugcuucgccuucaugcaccugugcauccaggaguucugcgccgccauguucuaccuccugaagcgccccaaggacgaccccaaccccgccaucggguccaucacccagcuggugcgggcgagcgugguccagccccagacccuccugacccaggugggcaucuucauguucgggaucuccacggaggagaucgugagcaugcuggagaccuccuucggcuucccgcucagcaaggaccugaagcaggagaucacccagugccuggagucccucagccagugcgaggccgaccgcgaggccaucgccuuccaggagcuguucaucgggcuguucgagacccaggagaaggaguucgucacgaaggugaugaacuucuucgaggagguguucaucuacaucggcaacaucgagcaccucgucaucgccuccuucugccugaagcacugccagcaccugaccacccuccggaugugcguggagaacaucuuccccgacgacagcggcugcaucuccgacuacaacgagaagcuggucuacuggcgcgagcugugcagcauguucaucaccaacaagaacuuccagauccucgacauggagaacacgucccuggacgaccccagccuggcgauccucugcaaggcccuggcccagcccgugugcaagcugcggaagcucaucuucaccuccguguacuucgggcacgacagcgagcuguucaaggccguccugcacaacccgcaccucaagcugcugagccucuacggcaccucccugagccaguccgacauccgccaccugugcgagacccucaagcaccccaugugcaagaucgaggagcugauccuggggaagugcgacaucagcuccgaggugugcgaggacaucgcgagcgugcucgccugcaacuccaagcugaagcaccugagccucgucgagaacccccugcgggacgagggcaugacgcugcucugcgaggcccugaagcacucccacugcgcccuggagcgccucaugcugauguacugcugccugaccagcguguccugcgacagcaucuccgaggugcuccugugcagcaagucccugagccuccuggaccugggguccaacgcccucgaggacaacggcgucgcgagccugugcgccgcccugaagcaccccggcugcagcauccgggagcucuggcugauggggugcuuccugaccuccgacagcugcaaggacaucgccgccgugcucaucugcaacggcaagcugaagacccugaagcucgggcacaacgagaucggcgacacgggggugcgccagcugugcgcggcccugcagcacccgcacugcaagcucgagugccugggccugcagaccugccccaucacccgggccugcugcgacgacaucgccgccgcgcucaucgccugcaagacccugcgcucccugaaccucgacuggaucgcccuggacgccgacgcggucguggugcugugcgaggcccucagccaccccgacugcgcccugcagaugcugggccuccacaaguccggguucgacgaggagacccagaagauccugaugagcgucgaggagaagaucccgcaccugacgaucucccacggccccuggaucgacgaggaguacaagauccgcggggugcuccuguga

SEQ ID NO: 9112 - RNA, 2976 nt, Artificial Sequence
  derived and/or modified sequence opt2 from NALP9__Homo_sapiens__AAI36584
auggccgaguccuucuucuccgacuucggccuccucugguaccucaaggagcuccgcaaggaggaguucuggaaguucaaggagcuccucaagcagccccucgagaaguucgagcucaagcccauccccugggccgagcucaagaaggccuccaaggaggacgucgccaagcuccucgacaagcacuaccccggcaagcaggccugggaggucacccucaaccucuuccuccagaucaaccgcaaggaccucuggaccaaggcccaggaggagaugcgcaacaagcucaaccccuaccgcaagcacaugaaggagaccuuccagcucaucugggagaaggagaccugccuccacguccccgagcacuucuacaaggagaccaugaagaacgaguacaaggagcucaacgacgccuacaccgccgccgcccgccgccacaccgucguccucgagggccccgacggcaucggcaagaccacccuccuccgcaaggucaugcucgacugggccgagggcaaccucuggaaggaccgcuucaccuucgucuucuuccucaacgucugcgagaugaacggcaucgccgagaccucccuccucgagcuccucucccgcgacuggcccgaguccuccgagaagaucgaggacaucuucucccagcccgagcgcauccucuucaucauggacggcuucgagcagcucaaguucaaccuccagcucaaggccgaccucuccgacgacuggcgccagcgccagcccaugcccaucauccucuccucccuccuccagaagaagaugcuccccgaguccucccuccucaucgcccucggcaagcucgccaugcagaagcacuacuucaugcuccgccaccccaagcucaucaagcuccucggcuucuccgaguccgagaagaaguccuacuucuccuacuucuucggcgagaaguccaaggcccucaaggucuucaacuucguccgcgacaacggcccccucuucauccucugccacaaccccuucaccugcuggcucgucugcaccugcgucaagcagcgccucgagcgcggcgaggaccucgagaucaacucccagaacaccaccuaccucuacgccuccuuccucaccaccgucuucaaggccggcucccaguccuucccccccaaggucaaccgcgcccgccucaagucccucugcgcccucgccgccgagggcaucuggaccuacaccuucgucuucucccacggcgaccuccgccgcaacggccucuccgaguccgagggcgucaugugggucggcaugcgccuccuccagcgccgcggcgacugcuucgccuucaugcaccucugcauccaggaguucugcgccgccauguucuaccuccucaagcgccccaaggacgaccccaaccccgccaucggcuccaucacccagcucguccgcgccuccgucguccagccccagacccuccucacccaggucggcaucuucauguucggcaucuccaccgaggagaucgucuccaugcucgagaccuccuucggcuucccccucuccaaggaccucaagcaggagaucacccagugccucgagucccucucccagugcgaggccgaccgcgaggccaucgccuuccaggagcucuucaucggccucuucgagacccaggagaaggaguucgucaccaaggucaugaacuucuucgaggaggucuucaucuacaucggcaacaucgagcaccucgucaucgccuccuucugccucaagcacugccagcaccucaccacccuccgcaugugcgucgagaacaucuuccccgacgacuccggcugcaucuccgacuacaacgagaagcucgucuacuggcgcgagcucugcuccauguucaucaccaacaagaacuuccagauccucgacauggagaacaccucccucgacgaccccucccucgccauccucugcaaggcccucgcccagcccgucugcaagcuccgcaagcucaucuucaccuccgucuacuucggccacgacuccgagcucuucaaggccguccuccacaacccccaccucaagcuccucucccucuacggcaccucccucucccaguccgacauccgccaccucugcgagacccucaagcaccccaugugcaagaucgaggagcucauccucggcaagugcgacaucuccuccgaggucugcgaggacaucgccuccguccucgccugcaacuccaagcucaagcaccucucccucgucgagaacccccuccgcgacgagggcaugacccuccucugcgaggcccucaagcacucccacugcgcccucgagcgccucaugcucauguacugcugccucaccuccgucuccugcgacuccaucuccgagguccuccucugcuccaagucccucucccuccucgaccucggcuccaacgcccucgaggacaacggcgucgccucccucugcgccgcccucaagcaccccggcugcuccauccgcgagcucuggcucaugggcugcuuccucaccuccgacuccugcaaggacaucgccgccguccucaucugcaacggcaagcucaagacccucaagcucggccacaacgagaucggcgacaccggcguccgccagcucugcgccgcccuccagcacccccacugcaagcucgagugccucggccuccagaccugccccaucacccgcgccugcugcgacgacaucgccgccgcccucaucgccugcaagacccuccgcucccucaaccucgacuggaucgcccucgacgccgacgccgucgucguccucugcgaggcccucucccaccccgacugcgcccuccagaugcucggccuccacaaguccggcuucgacgaggagacccagaagauccucauguccgucgaggagaagaucccccaccucaccaucucccacggccccuggaucgacgaggaguacaagauccgcggcguccuccucuga

SEQ ID NO: 9113 - RNA, 2976 nt, Artificial Sequence
  derived and/or modified sequence opt3 from NALP9__Homo_sapiens__AAI36584
auggccgagagcuucuuuuccgacuucggccugcucugguaccuuaaggaacugagaaaagaggaauuuuggaaguucaaagaguuguuaaagcagccccuggaaaaauuugagcuaaagccuaucccaugggcugagcucaagaaagcaucuaaggaagauguggccaaacugcuugacaagcacuauccggggaaacaagcgugggaggucacccugaacuuguuccuccagauuaauaggaaggaucuguggacaaaggcucaggaagagaugcggaacaaacugaaucccuaccgcaagcauaugaaagagacuuuucagcucauaugggaaaaggagacgugcuuacacguuccugaacauuucuauaaagagaccaugaagaacgaauacaaagagcugaaugacgccuauacagcagccgcucgacgucacacugugguacuugagggaccagaugguaucggcaagaccacauugcugagaaaggugaugcuagacugggcagaagggaaccucuggaaagauagguuuaccuucgucuuuuuccugaaugugugugagaugaacggaauugccgaaacuucacuucuggaguugcucagucgggacuggcccgaaagcuccgagaagaucgaggauauuuuuagccaaccugaacgcauccuguucauaauggacggcuucgagcaguuaaaauuuaaucugcagcucaaggcugaucuuucggacgauuggagacagaggcaaccaaugcccaucauucugucaucuuugcuacagaaaaagaugcugccugaaaguucccuccugaucgcccuugguaagcuggcgaugcagaaacauuacuucauguugcggcacccaaagcucauuaaacuguuaggguuuucugagagcgaaaagaaauccuauuucucauacuuuuucggagagaagaguaaggcacugaaaguuuuuaacuucgugcgcgacaauggcccgcuauuuauccucugccacaaccccuucacauguuggcuggucugcaccugugugaagcagcgacuugagagaggcgaagacuuggagauaaauagccaaaacacgacuuaccuguaugccucuuuucucaccacaguauucaaagcugggucccagucauuuccuccaaagguuaauagggcccggcugaaaagccuuugcgcacuggcugccgaaggaauuuggacuuacaccuucguguucagucauggugauuugcgucgcaacggccucucugaguccgagggggucaugugggugggaaugagacuguuacagaggcggggcgacuguuuugcguucaugcaccugugcauccaagaauuuugugccgcaauguucuaucuacucaagcgacccaaggaugacccuaacccagcuauugguagcaucacacagcuggugcgcgccucggucguucagccccagacccuuuugacgcaaguggggaucuuuauguucggaauuucuacugaggaaauaguauccaugcuggagacaucauuuggcuucccgcucaguaaagaucugaagcaggaaaucacccagugcuuagagagccugucccagugugaggcugacagagaagccauugcauuucaagagcuuuucaucggcuuguuugaaacucaggagaaagaauuugugacaaaggucaugaauuucuucgaggagguguucauauacauugggaacaucgaacaucucguuaucgccucuuuuugccugaaacacugccagcaccuaaccacgcugaggauguguguggagaauauuuucccugaugacagcggaugcaucucagauuauaacgaaaagcucgucuacuggcgggagcuguguaguauguuuauuaccaauaaaaacuuccagauacuugacauggaaaauacauccuuggaugaccccagccuggcuaucuuaugcaaggcgcucgcacaaccaguguguaagcugcgcaaacuuauuuuuacuucuguauauuucggucaugacucagagcuguuuaaggccguuuugcacaacccucaucucaaacugcuaagucuguacggcaccagccucucccagucugauaucagacaccugugcgagacacuuaagcaucccauguguaaaaucgaagaguugauucuggggaagugcgacauaucgagcgaagugugugaggauaucgcuuccgucuuagccugcaauucaaagcucaaacaccugagucuuguggagaacccacugagggacgaaggaaugacucuacucugugaggcacugaagcacucucauugcgccuuggaacgucugauguuaauguacugcugucucaccagcgucuccugcgauucaauuagcgaggugcugcuuuguucuaaaucccugaguuugcucgaccugggcagcaaugcucuagaagauaacgguguugccucucugugcgcagcgcuuaagcaccccggguguuccauccgggagcucuggcugaugggcugcuucuugacaucagacaguuguaaagauauugcugccgugcugaucugcaauggaaaguuaaagacccucaaacugggccauaacgagauaggggacacuggaguacgacagcuuugugcagcccugcagcacccucacugcaaguuggaaugucucggucugcaaacgugcccaaucacaagagcuugcugugaugacauugccgcagcucuaaucgccugcaaaacccugaggagccuuaaucucgauuggauugcgcuggacgccgacgcugucgugguuuugugugaggcauuaucgcauccggauugcgcccugcagaugcucggccugcacaaguccggguuugacgaagagacucagaaaauccuuaugucuguggaagagaagauaccccaucugaccauuagccacggaccuuggaucgaugaggaauauaagauucgcggcgucuugcuauga

SEQ ID NO: 9114 - RNA, 2976 nt, Artificial Sequence
  derived and/or modified sequence opt4 from NALP9__Homo_sapiens__AAI36584
auggccgagagcuucuucagcgacuucggccugcugugguaccugaaggagcugagaaaggaggaguucuggaaguucaaggagcugcugaagcagccccuggagaaguucgagcugaagcccauccccugggccgagcugaagaaggccagcaaggaggacguggccaagcugcuggacaagcacuaccccggcaagcaggccugggaggugacccugaaccuguuccugcagaucaacagaaaggaccuguggaccaaggcccaggaggagaugagaaacaagcugaaccccuacagaaagcacaugaaggagaccuuccagcugaucugggagaaggagaccugccugcacgugcccgagcacuucuacaaggagaccaugaagaacgaguacaaggagcugaacgacgccuacaccgccgccgccagaagacacaccguggugcuggagggccccgacggcaucggcaagaccacccugcugagaaaggugaugcuggacugggccgagggcaaccuguggaaggacagauucaccuucguguucuuccugaacgugugcgagaugaacggcaucgccgagaccagccugcuggagcugcugagcagagacuggcccgagagcagcgagaagaucgaggacaucuucagccagcccgagagaauccuguucaucauggacggcuucgagcagcugaaguucaaccugcagcugaaggccgaccugagcgacgacuggagacagagacagcccaugcccaucauccugagcagccugcugcagaagaagaugcugcccgagagcagccugcugaucgcccugggcaagcuggccaugcagaagcacuacuucaugcugagacaccccaagcugaucaagcugcugggcuucagcgagagcgagaagaagagcuacuucagcuacuucuucggcgagaagagcaaggcccugaagguguucaacuucgugagagacaacggcccccuguucauccugugccacaaccccuucaccugcuggcuggugugcaccugcgugaagcagagacuggagagaggcgaggaccuggagaucaacagccagaacaccaccuaccuguacgccagcuuccugaccaccguguucaaggccggcagccagagcuucccccccaaggugaacagagccagacugaagagccugugcgcccuggccgccgagggcaucuggaccuacaccuucguguucagccacggcgaccugagaagaaacggccugagcgagagcgagggcgugaugugggugggcaugagacugcugcagagaagaggcgacugcuucgccuucaugcaccugugcauccaggaguucugcgccgccauguucuaccugcugaagagacccaaggacgaccccaaccccgccaucggcagcaucacccagcuggugagagccagcguggugcagccccagacccugcugacccaggugggcaucuucauguucggcaucagcaccgaggagaucgugagcaugcuggagaccagcuucggcuucccccugagcaaggaccugaagcaggagaucacccagugccuggagagccugagccagugcgaggccgacagagaggccaucgccuuccaggagcuguucaucggccuguucgagacccaggagaaggaguucgugaccaaggugaugaacuucuucgaggagguguucaucuacaucggcaacaucgagcaccuggugaucgccagcuucugccugaagcacugccagcaccugaccacccugagaaugugcguggagaacaucuuccccgacgacagcggcugcaucagcgacuacaacgagaagcugguguacuggagagagcugugcagcauguucaucaccaacaagaacuuccagauccuggacauggagaacaccagccuggacgaccccagccuggccauccugugcaaggcccuggcccagcccgugugcaagcugagaaagcugaucuucaccagcguguacuucggccacgacagcgagcuguucaaggccgugcugcacaacccccaccugaagcugcugagccuguacggcaccagccugagccagagcgacaucagacaccugugcgagacccugaagcaccccaugugcaagaucgaggagcugauccugggcaagugcgacaucagcagcgaggugugcgaggacaucgccagcgugcuggccugcaacagcaagcugaagcaccugagccugguggagaacccccugagagacgagggcaugacccugcugugcgaggcccugaagcacagccacugcgcccuggagagacugaugcugauguacugcugccugaccagcgugagcugcgacagcaucagcgaggugcugcugugcagcaagagccugagccugcuggaccugggcagcaacgcccuggaggacaacggcguggccagccugugcgccgcccugaagcaccccggcugcagcaucagagagcuguggcugaugggcugcuuccugaccagcgacagcugcaaggacaucgccgccgugcugaucugcaacggcaagcugaagacccugaagcugggccacaacgagaucggcgacaccggcgugagacagcugugcgccgcccugcagcacccccacugcaagcuggagugccugggccugcagaccugccccaucaccagagccugcugcgacgacaucgccgccgcccugaucgccugcaagacccugagaagccugaaccuggacuggaucgcccuggacgccgacgccgugguggugcugugcgaggcccugagccaccccgacugcgcccugcagaugcugggccugcacaagagcggcuucgacgaggagacccagaagauccugaugagcguggaggagaagaucccccaccugaccaucagccacggccccuggaucgacgaggaguacaagaucagaggcgugcugcuguga

SEQ ID NO: 9115 - RNA, 2976 nt, Artificial Sequence
  derived and/or modified sequence opt5 from NALP9__Homo_sapiens__AAI36584
auggccgagagcuucuuuuccgacuucggccugcucugguaccugaaggaacuuagaaaagaggaauuuuggaaguucaaagagcugcucaagcagccccuggaaaaauuugagcuuaagccuaucccgugggcugagcugaagaaagccucuaaggaagauguggcgaaacuccuggacaagcacuaucccgggaaacaggcuugggaggucacccugaaccucuuccugcaaauuaaucggaaggaucuuuggacaaaggcccaggaagagaugcgcaacaaacugaauccuuacagaaagcauaugaaagagacguuucagcucaucugggaaaaggagaccugccugcacguucccgaacauuucuauaaagagacaaugaagaacgaauacaaagagcuuaaugacgccuauaccgcugccgcucggcgccacacaguggugcuggagggaccugauggcauugggaagaccacacuccugagaaaggucaugcuggacugggccgaaggaaaccucuggaaagaucgguuuaccuucguguuuuuccugaauguuugugagaugaacggcaucgcggaaacgagccuucuggagcuccugucccgcgacuggcccgaaucuagcgagaagauugaggauaucuuuucccaaccugaaagaauccuuuucauuauggacggguucgagcagcugaaauuuaaucuccagcugaaggccgaucugucugacgauuggcggcagcgccaaccgaugcccaucauucucagcucccugcuucagaaaaagaugcugccugaaagcucucuccugaucgcucuuggaaagcuggccaugcagaaacauuacuucaugcucagacaccccaagcugauuaaacugcucggcuuuuccgagagcgaaaagaaaucuuauuucuccuacuuuuucggcgaaaagagcaaggcucugaaaguguuuaacuucguccgggacaaugggccucuuuuuauccugugccacaaccccuucaccuguuggcucgugugcacauguguuaagcagcgccuggagagaggagaagaccuggagauuaauucucaaaacaccacauaccuuuaugccuccuuucucaccacgguguucaaagcgggcagccaguccuuuccgccuaaggucaaucgggcccgccugaaaucucugugcgcucucgccgcugaagggaucuggacauacaccuucguguucagccauggagaucugagacggaacggccuuuccgagagcgagggggugaugugggucggaaugagacugcuccagcgccggggcgacuguuuugccuucaugcaccugugcauccaagaauuuugugccgcuauguucuaucugcuuaagagacccaaggaugacccuaaccccgcgauuggcucuaucacacagcucguucgcgccuccguggugcagccccagacccugcugacccaagucgggauuuuuauguucggaaucagcacagaggaaauugugucuaugcucgagacgagcuuuggcuucccucuguccaaagaucuuaagcaggaaaucacccagugccuggagucucucagccagugugaggcugaccgggaagccaucgccuuucaagagcuguucauugggcuguuugaaacacaggagaaagaauuuguuaccaaggugaugaauuucuucgaggaggucuucaucuacauuggaaacaucgaacaucuugugauugcuuccuuuugccucaaacacugccagcaccugacaacccugagaauguguguugagaauaucuucccggaugacagcggcugcaucucugauuauaacgaaaagcucguguacuggcgcgagcuguguuccauguuuauuacgaauaaaaacuuccagauccuugacauggaaaauacaagccuggaugaccccucucucgccauucugugcaaggcgcuggcucaaccugucuguaaacuucggaagcucaucuuuaccuccguguauuucgggcaugacagcgagcuguuuaaggccguccugcacaacccccaucucaaacugcuuucccuguacggaaccucucucagccaguccgauauuagacaccugugcgagacacugaagcauccuauguguaaaaucgaggagcuuauucugggcaagugcgacaucucuagcgaagugugugaggauaucgccuccguucucgcuugcaauagcaagcugaaacaccucucucugguggagaacccccuucgcgacgaaggcaugacccugcucugugaggcccugaagcacucccauugcgcucuggaacggcuuaugcugauguacugcugucucacaagcgucucuugcgauuccauuagcgaggugcugcucuguucuaaaagccugucccuucuggaccucgggagcaaugcccuggaagauaacggaguugcgucucugugcgccgcucuuaagcacccgggcuguuccaucagagagcuguggcucauggggugcuuccugacgagcgacuccuguaaagauauugccgcugugcucaucugcaauggaaagcugaagacccuuaaacugggccauaacgagauuggggacacaggcguccgccagcugugugccgcgcuccagcacccucacugcaagcuggaaugucuuggacugcaaaccugccccaucacacgggccugcugugaugacaucgcugccgcucucauugccugcaaaacccugagaucucucaaucuggauuggaucgcccuugacgcugacgcgguggugguucugugugaggcccugagccauccugauugcgcucuccagaugcugggccuucacaaguccggguuugacgaagagacgcagaaaauucugaugucugucgaagagaagaucccccaucucaccauuagccacggaccuuggaucgaugaggaauauaagauccggggcgugcugcucuga

SEQ ID NO: 9116 - protein, 690 aa, Artificial Sequence [sequence omitted]

SEQ ID NO: 9117 - RNA, 2073 nt, Artificial Sequence
  NF-kappaB__Homo_sapiens__ABN11234
auggaaaaaauucuccaaauggcugaagguauugauauuggggagaugccuucauaugaucuggugcuguccaaaccuuccaaaggucaaaaacgccaccucucaacaugugauggucaaaauccuccuaaaaagcaagccgguuccaaauuccaugcgagaccucguuuugagccuguacauuuuguagcuaguaguucaaaagaugaaggacaggaagauccuuauggcccucaaacaaaagagguaaaugaacaaacacauuuugccagcaugccaagagacaucuaccaagauuauacucaagacucuuucaguauacaagaugggaauucucaguauugugauucaucaggauucauucucacaaaagaccagccuguaacagccaacauguauuuugacagugggaacccugccccaagcaccacaucacagcaggcaaacucucagucaacuccugagccuucaccaucacagacauuucccgagucugugguagccgagaagcaguauuuuauugaaaaauuaacggcgacaaucuggaagaaccuuucuaauccagaaaugacuucuggaucugauaaaauuaauuauacauauauguuaacucguuguauucaggcguguaagacaaauccugaguauauauaugcuccuuuaaaggaaauuccuccugccgacauccccaaaaauaaaaaacuucuaacugauggcuaugcuugugaaguuagaugccaaaauaucuacuuaacuacagguuaugcuggcagcaagaauggguccagggaucgagcuacagagcuagcuguaaaacucuugcagaaacguauugaaguuagaguuguccggcggaaauucaagcauacauuuggagaggaccucguggugugucagauuggcauguccuccuaugaauuuccuccagcucugaagccaccagaagaccugguggugcuggguaaagaugcuuccgggcagccaauuuuuaaugcuucugccaaacacuggaccaauuuugucauuacagaaaaugcaaaugaugcaauugguauccuuaacaauucugccucauucaacaagaugucaauugaauacaaauaugagaugaugccaaaucgcacauggcguugucgaguguuuuuacaagaucacugcuuagcugaagguuauggaaccaagaaaacaaguaaacaugcagcugccgacgaggcuuugaaaauucuucaaaaaacacagcccacuuauccaucugucaaaaguucacaaugccauacaggcucuucacccagaggaucuggaaagaagaaagauauaaaggaucuuguaguuuaugagaauucuucaaaucccgugugcacgcugaacgacacagcucaguuuaaccgaaugacaguugaguaugucuaugaaaggaugacaggccuccgcuggaaaugcaaagugauucuagagagugaaguaauugcagaagcaguuggggugaagaaaacugucaaauaugaagcugcuggggaagcugugaaaacccucaaaaagacccagccaacugucauuaacaacuugaagaaaggagcuguugaagaugugauuucaagaaaugaaauucagggccgcucagcagaggaggcuuacaaacagcaaaucaaagaagauaauauuggaaaucagcugcugagaaagauggguuggacugguggugguuuagguaaaucuggugagggcauacgggagccuaucucagugaaagagcagcauaagcgggaagggcuuggucuggauguagagagggugaauaaaauugccaagagagauauugaacagaucaucagaaacuacgcccgcuccgagagccacacagauuugacuuucucuagagagcugacuaaugaugaacggaagcaaauacaucagauugcccagaaguauggucuuaagaguaagucucauggggugggccaugauagguaccuagugguagguagaaaaagacggaaggaagaccuacuagaucagcucaaacaggaaggccaagugggccauuacgagcuuguuaugccucaagcaaauuga

SEQ ID NO: 9118 - RNA, 2073 nt, Artificial Sequence
  derived and/or modified sequence opt1 from NF-kappaB__Homo_sapiens__ABN11234
auggagaagauccugcagauggccgagggcaucgacaucggggagaugcccagcuacgaccucgugcuguccaagccgagcaagggccagaagcgccaccuguccacgugcgacgggcagaacccgcccaagaagcaggccggcagcaaguuccacgcgcggccccgcuucgagcccguccacuucguggccuccagcuccaaggacgaggggcaggaggaccccuacggcccccagaccaaggaggugaacgagcagacccacuucgccagcaugccccgggacaucuaccaggacuacacccaggacuccuucagcauccaggacggcaacucccaguacugcgacagcuccggguucauccucaccaaggaccagccggucaccgccaacauguacuucgacagcggcaaccccgcccccuccacgaccagccagcaggcgaacucccagagcacccccgagccgucccccagccagaccuuccccgagagcgugguggccgagaagcaguacuucaucgagaagcugacggccaccaucuggaagaaccuguccaaccccgagaugaccagcggguccgacaagaucaacuacaccuacaugcucacgcgcugcauccaggccugcaagaccaacccggaguacaucuacgcgccccugaaggagaucccgcccgccgacauccccaagaacaagaagcugcucaccgacggcuacgccugcgagguccggugccagaacaucuaccugaccacgggguacgccggcagcaagaacggcucccgcgaccgggccaccgagcuggcggugaagcuccugcagaagcgcaucgaggugcgggucgugcgccggaaguucaagcacaccuucggggaggaccugguggucugccagaucggcaugagcuccuacgaguucccgcccgcccucaagccgcccgaggaccugguggugcuggggaaggacgccagcggccagcccaucuucaacgccuccgccaagcacuggaccaacuucgucaucacggagaacgcgaacgacgccaucggcauccucaacaacagcgccuccuucaacaagaugagcaucgaguacaaguacgagaugaugcccaaccgcaccuggcggugccgcguguuccugcaggaccacugccuggccgagggguacggcaccaagaagaccuccaagcacgccgcggccgacgaggcccucaagauccugcagaagacgcagcccaccuaccccagcgugaaguccagccagugccacaccggguccagcccccggggcuccgggaagaagaaggacaucaaggaccuggucguguacgagaacagcagcaaccccgugugcacccucaacgacacggcccaguucaaccgcaugaccgucgaguacguguacgagcggaugaccggccugcgcuggaagugcaaggugauccuggaguccgaggucaucgccgaggcggugggcgucaagaagaccgugaaguacgaggccgccggggaggccgugaagacgcucaagaagacccagccgaccgucaucaacaaccugaagaagggcgcgguggaggacgugaucagccggaacgagauccaggggcgcuccgccgaggaggccuacaagcagcagaucaaggaggacaacaucggcaaccagcugcuccggaagaugggguggaccggcggcgggcugggcaagagcggggagggcauccgcgagcccaucuccgucaaggagcagcacaagcgcgaggggcugggccucgacguggagcgggugaacaagaucgccaagcgcgacaucgagcagaucauccggaacuacgcccgcagcgagucccacacggaccugaccuucagccgggagcugaccaacgacgagcgcaagcagauccaccagaucgcgcagaaguacggccucaaguccaagagccacggggucggccacgaccgguaccuggugguggggcgcaagcggcgcaaggaggaccugcucgaccagcugaagcaggagggccaggucggccacuacgagcuggugaugccccaggccaacuga

SEQ ID NO: 9119 - RNA, 2073 nt, Artificial Sequence
  derived and/or modified sequence opt2 from NF-kappaB__Homo_sapiens__ABN11234
auggagaagauccuccagauggccgagggcaucgacaucggcgagaugcccuccuacgaccucguccucuccaagcccuccaagggccagaagcgccaccucuccaccugcgacggccagaacccccccaagaagcaggccggcuccaaguuccacgcccgcccccgcuucgagcccguccacuucgucgccuccuccuccaaggacgagggccaggaggaccccuacggcccccagaccaaggaggucaacgagcagacccacuucgccuccaugccccgcgacaucuaccaggacuacacccaggacuccuucuccauccaggacggcaacucccaguacugcgacuccuccggcuucauccucaccaaggaccagcccgucaccgccaacauguacuucgacuccggcaaccccgcccccuccaccaccucccagcaggccaacucccaguccacccccgagcccucccccucccagaccuuccccgaguccgucgucgccgagaagcaguacuucaucgagaagcucaccgccaccaucuggaagaaccucuccaaccccgagaugaccuccggcuccgacaagaucaacuacaccuacaugcucacccgcugcauccaggccugcaagaccaaccccgaguacaucuacgccccccucaaggagaucccccccgccgacauccccaagaacaagaagcuccucaccgacggcuacgccugcgagguccgcugccagaacaucuaccucaccaccggcuacgccggcuccaagaacggcucccgcgaccgcgccaccgagcucgccgucaagcuccuccagaagcgcaucgagguccgcgucguccgccgcaaguucaagcacaccuucggcgaggaccucgucgucugccagaucggcauguccuccuacgaguucccccccgcccucaagccccccgaggaccucgucguccucggcaaggacgccuccggccagcccaucuucaacgccuccgccaagcacuggaccaacuucgucaucaccgagaacgccaacgacgccaucggcauccucaacaacuccgccuccuucaacaagauguccaucgaguacaaguacgagaugaugcccaaccgcaccuggcgcugccgcgucuuccuccaggaccacugccucgccgagggcuacggcaccaagaagaccuccaagcacgccgccgccgacgaggcccucaagauccuccagaagacccagcccaccuaccccuccgucaaguccucccagugccacaccggcuccuccccccgcggcuccggcaagaagaaggacaucaaggaccucgucgucuacgagaacuccuccaaccccgucugcacccucaacgacaccgcccaguucaaccgcaugaccgucgaguacgucuacgagcgcaugaccggccuccgcuggaagugcaaggucauccucgaguccgaggucaucgccgaggccgucggcgucaagaagaccgucaaguacgaggccgccggcgaggccgucaagacccucaagaagacccagcccaccgucaucaacaaccucaagaagggcgccgucgaggacgucaucucccgcaacgagauccagggccgcuccgccgaggaggccuacaagcagcagaucaaggaggacaacaucggcaaccagcuccuccgcaagaugggcuggaccggcggcggccucggcaaguccggcgagggcauccgcgagcccaucuccgucaaggagcagcacaagcgcgagggccucggccucgacgucgagcgcgucaacaagaucgccaagcgcgacaucgagcagaucauccgcaacuacgcccgcuccgagucccacaccgaccucaccuucucccgcgagcucaccaacgacgagcgcaagcagauccaccagaucgcccagaaguacggccucaaguccaagucccacggcgucggccacgaccgcuaccucgucgucggccgcaagcgccgcaaggaggaccuccucgaccagcucaagcaggagggccaggucggccacuacgagcucgucaugccccaggccaacuga

SEQ ID NO: 9120 - RNA, 2073 nt, Artificial Sequence
  derived and/or modified sequence opt3 from NF-kappaB__Homo_sapiens__ABN11234
auggagaagauccugcagauggccgaaggcauugacauaggggagaugcccagcuacgaucucgugcuuuccaaaccuucuaagggacagaaaagacaccugucaaccugcgacggucaaaacccaccgaagaaacaggcuggcaguaaguuccaugcaaggccccgguuugaaccuguccacuucguugccagcuccucuaaggaugaggggcaggaagacccauauggaccccaaacaaaagaggugaaugagcagacucauuuugcgucgaugccucgcgauaucuaccaggacuauacgcaggauucauucagcauucaagacggcaacagucaguacugugauuccucugguuuuaucuugaccaaggaccagccaguaacagcuaauauguauuucgauagcgggaaccccgccccuuccacuaccucacagcaagcaaauagucagagcacaccagaaccgucucccucccagaccuuuccugagucaguggucgccgaaaaacaauacuucauugagaaguuaacugcuacaaucuggaaaaaccugagcaauccagagaugaccaguggaucugacaagauaaacuauacguacaugcuaacucgaugcauccaggcauguaagaccaaucccgaauacauuuaugccccucucaaagagaucccacccgcugauauuccgaagaacaaaaagcugcuuacagacggcuacgccugcgaagugcguugucagaauaucuaucugacuaccggcuacgcgggguccaaaaacggaagcagagacagggcaacagaguuggccguuaagcuccugcagaaacggauagaagugcgcgucgugagaaggaaguuuaagcacaccuucggugaggaucugguaguuugccaaauuggcaugucgucuuaugaguuuccucccgcucucaaaccaccugaagacuuagugguccuggggaaggaugccuccggacagcccaucuucaaugcaucagcuaaacauuggacgaacuuugugauuacugagaaugccaacgacgcgaucggcauccuuaacaauagugccagcuucaacaagauguccauugaauacaaauaugagaugaugccaaaucggacauggcgcugucgaguguucuugcaggaucacugccuggcagaagguuacgggaccaagaagacuucuaaacacgcugccgcugacgaggcccuaaagauacuccagaaaacacaacccaccuacccuagcgucaagucaagucagugucauacgggauccagcccaagaggcucuggcaaaaagaaggauaucaaagaccugguuguguaugagaacucaaguaauccgguaugcacccuuaacgauacagcacaguuuaauaggaugacuguggaauacgucuaugagcggaugaccgggcugcguuggaaguguaaagugauuuuggaaagcgagguuaucgccgaagcugugggagucaagaaaacagugaaguacgaggcggccggugaggcaguaaagacucucaaaaagacccagcccacaguuauaaacaaucugaaaaagggcgcuguggaagacgucauuucccgcaacgagauccaagggagaucugccgaagaggcauauaaacagcagaucaaggaggauaauauuggaaaccaguuacugaggaaaaugggcuggaccggugggggccucggaaagucgggcgaagggauccgggagccuauuagcgugaaggaacaacacaaacgagagggacuuggucuggacgucgaacgcgugaauaagauagccaaaagagacaucgagcagauuaucaggaacuacgcucgguccgagucacauacugauuugacguucagucgcgaacuaacaaaugacgagagaaagcagauccaccaaauugcccagaaauauggccugaagucuaagagccacgggguuggacaugauagguaccucgugguaggccguaaacggcgaaaggaagaccugcuugaucagcugaaacaggagggucaagucgggcacuacgaauuggugaugccacaggcaaacuga

SEQ ID NO: 9121 - RNA, 2073 nt, Artificial Sequence
  derived and/or modified sequence opt4 from NF-kappaB__Homo_sapiens__ABN11234
auggagaagauccugcagauggccgagggcaucgacaucggcgagaugcccagcuacgaccuggugcugagcaagcccagcaagggccagaagagacaccugagcaccugcgacggccagaacccccccaagaagcaggccggcagcaaguuccacgccagacccagauucgagcccgugcacuucguggccagcagcagcaaggacgagggccaggaggaccccuacggcccccagaccaaggaggugaacgagcagacccacuucgccagcaugcccagagacaucuaccaggacuacacccaggacagcuucagcauccaggacggcaacagccaguacugcgacagcagcggcuucauccugaccaaggaccagcccgugaccgccaacauguacuucgacagcggcaaccccgcccccagcaccaccagccagcaggccaacagccagagcacccccgagcccagccccagccagaccuuccccgagagcgugguggccgagaagcaguacuucaucgagaagcugaccgccaccaucuggaagaaccugagcaaccccgagaugaccagcggcagcgacaagaucaacuacaccuacaugcugaccagaugcauccaggccugcaagaccaaccccgaguacaucuacgccccccugaaggagaucccccccgccgacauccccaagaacaagaagcugcugaccgacggcuacgccugcgaggugagaugccagaacaucuaccugaccaccggcuacgccggcagcaagaacggcagcagagacagagccaccgagcuggccgugaagcugcugcagaagagaaucgaggugagaguggugagaagaaaguucaagcacaccuucggcgaggaccugguggugugccagaucggcaugagcagcuacgaguucccccccgcccugaagccccccgaggaccugguggugcugggcaaggacgccagcggccagcccaucuucaacgccagcgccaagcacuggaccaacuucgugaucaccgagaacgccaacgacgccaucggcauccugaacaacagcgccagcuucaacaagaugagcaucgaguacaaguacgagaugaugcccaacagaaccuggagaugcagaguguuccugcaggaccacugccuggccgagggcuacggcaccaagaagaccagcaagcacgccgccgccgacgaggcccugaagauccugcagaagacccagcccaccuaccccagcgugaagagcagccagugccacaccggcagcagccccagaggcagcggcaagaagaaggacaucaaggaccuggugguguacgagaacagcagcaaccccgugugcacccugaacgacaccgcccaguucaacagaaugaccguggaguacguguacgagagaaugaccggccugagauggaagugcaaggugauccuggagagcgaggugaucgccgaggccgugggcgugaagaagaccgugaaguacgaggccgccggcgaggccgugaagacccugaagaagacccagcccaccgugaucaacaaccugaagaagggcgccguggaggacgugaucagcagaaacgagauccagggcagaagcgccgaggaggccuacaagcagcagaucaaggaggacaacaucggcaaccagcugcugagaaagaugggcuggaccggcggcggccugggcaagagcggcgagggcaucagagagcccaucagcgugaaggagcagcacaagagagagggccugggccuggacguggagagagugaacaagaucgccaagagagacaucgagcagaucaucagaaacuacgccagaagcgagagccacaccgaccugaccuucagcagagagcugaccaacgacgagagaaagcagauccaccagaucgcccagaaguacggccugaagagcaagagccacggcgugggccacgacagauaccugguggugggcagaaagagaagaaaggaggaccugcuggaccagcugaagcaggagggccaggugggccacuacgagcuggugaugccccaggccaacuga

SEQ ID NO: 9122 - RNA, 2073 nt, Artificial Sequence
  derived and/or modified sequence opt5 from NF-kappaB__Homo_sapiens__ABN11234
auggagaagauccugcagauggccgaaggcauugacaucggggagaugcccagcuacgaucucgugcuguccaaaccuucuaagggacagaaaagacaccuuagcacaugcgacggccaaaacccgcccaagaaacaggcuggguccaaguuccaugcccggccucgcuuugaacccguccacuucguugcgucuagcuccaaggaugagggacaggaagacccuuauggcccccaaaccaaagaggugaaugagcagacgcauuuugcuucuaugccuagagauauuuaccaggacuauacccaggauagcuucuccauccaagacgggaacagccaguacugugauucuuccggauuuauucugacaaaggaccagccggugaccgccaauauguauuucgauagcggcaaccccgccccuucuacaaccucccagcaagcuaauagccagucuacacccgaaccuucccccagccagaccuuuccggaguccgucguggccgaaaaacaauacuucaucgagaagcucacggcuaccaucuggaaaaaccugucuaauccugagaugacaagcggcuccgacaagauuaacuauaccuacaugcuuacacggugcauccaggccuguaagaccaaucccgaauacauuuaugcgccucugaaagagaucccucccgccgauauucccaagaacaaaaagcuccugacggacggguacgcuugcgaaguucgcugucagaauaucuaucugacaaccggauacgccggcagcaaaaacgggucuagagaccgggcuacagagcucgccgugaagcugcuucagaaacgcauugaagucagagugguucggcgcaaguuuaagcacaccuucggagaggaucugguggucugccaaaucggcauguccagcuaugaguuuccgcccgcgcucaaaccucccgaagaccugguggugcuugggaaggaugccucuggacagccuaucuucaaugcuagcgccaaacauuggaccaacuuugucauuacagagaaugcuaacgacgccaucggcauucugaacaauuccgccucuuucaacaagaugagcaucgaauacaaauaugagaugaugcccaauagaacguggcggugucgcguuuuccuccaggaucacugccuggcugaaggcuacgggaccaagaagacauccaaacacgcggccgcugacgaggcccugaagauucuccagaaaacccaaccgacauacccuagcgugaagucuucccagugucauaccggaagcucucccagaggcuccgggaaaaagaaggauaucaaagaccugguggucuaugagaacagcuccaauccugugugcacgcuuaacgauacagcccaguuuaaucggaugaccguugaauacguguaugagcgcaugaccggacugagauggaaguguaaagucauccucgaaucugaggugauugcugaagccguuggcgugaagaaaacagucaaguacgaggcggcuggggaggccgugaagacccugaaaaagacacagcccacggucaucaacaaucuuaaaaagggagccguggaagacguuauuagccggaacgagauccaaggcagauccgcugaagaggccuauaaacagcagauuaaggaggauaauaucggcaaccagcugcuccgcaaaaugggguggaccggaggcgggcugggaaagucuggcgaagggauccgggagccuauuagcgugaaggaacaacacaaaagagagggccugggacucgacgucgaacgcgugaauaagaucgcuaaacgggacauugagcagaucauuagaaacuacgcccgcuccgagagccauacagaucugaccuucucucgggaacuuacaaaugacgagagaaagcagauccaccaaauugcgcagaaauauggccugaaguccaagagccacgggguuggacaugaucgcuaccucguggucggccggaaaagacgcaaggaagaccugcuugaucagcugaaacaggaggggcaagugggacacuacgaacucgugaugccccaggccaacuga

SEQ ID NO: 9123 - protein, 690 aa, Artificial Sequence
  NF-kappaB__Homo_sapiens__A3F769
MEKILQMAEGIDIGEMPSYDLVLSKPSKGQKRHLSTCDGQNPPKKQAGSKFHARPRFEPVHFVASSSKDERQEDPYGPQTKEVNEQTHFASMPRDIYQDYTQDSFSIQDGNSQYCDSSGFILTKDQPVTANMYFDSGNPAPSTTSQQANSQSTPEPSPSQTFPESVVAEKQYFIEKLTATIWKNLSNPEMTSGSDKINYTYMLTRCIQACKTNPEYIYAPLKEIPPADIPKNKKLLTDGYACEVRCQNIYLTTGYAGSKNGSRDRATELAVKLLQKRIEVRVVRRKFKHTFGEDLVVCQIGMSSYEFPPALKPPEDLVVLGKDASGQPIFNASAKHWTNFVITENANDAIGILNNSASFNKMSIEYKYEMMPNRTWRCRVFLQDHCLAEGYGTKKTSKHAAADEALKILQKTQPTYPSVKSSQCHTGSSPRGSGKKKDIKDLVVYENSSNPVCTLNDTAQFNRMTVEYVYERMTGLRWKCKVILESEVIAEAVGVKKTVKYEAAGEAVKTLKKTQPTVINNLKKGAVEDVISRNEIQGRSAEEAYKQQIKEDNIGNQLLRKMGWTGGGLGKSGEGIREPISVKEQHKREGLGLDVERVNKIAKRDIEQIIRNYARSESHTDLTFSRELTNDERKQIHQIAQKYGLKSKSHGVGHDRYLVVGRKRRKEDLLDQLKQEGQVGHYELVMPQAN

SEQ ID NO: 9124 - RNA, 2073 nt, Artificial Sequence
  NF-kappaB__Homo_sapiens__ABN11235
auggaaaaaauucuccaaauggcugaagguauugauauuggggagaugccuucauaugaucuggugcuguccaaaccuuccaaaggucaaaaacgccaccucucaacaugugauggucaaaauccuccuaaaaagcaagccgguuccaaauuccaugcgagaccucguuuugagccuguacauuuuguagcuaguaguucaaaagaugaaagacaggaagauccuuauggcccucaaacaaaagagguaaaugaacaaacacauuuugccagcaugccaagagacaucuaccaagauuauacucaagacucuuucaguauacaagaugggaauucucaguauugugauucaucaggauucauucucacaaaagaccagccuguaacagccaacauguauuuugacagugggaacccugccccaagcaccacaucacagcaggcaaacucucagucaacuccugagccuucaccaucacagacauuucccgagucugugguagccgagaagcaguauuuuauugaaaaauuaacggcgacaaucuggaagaaccuuucuaauccagaaaugacuucuggaucugauaaaauuaauuauacauauauguuaacucguuguauucaggcguguaagacaaauccugaguauauauaugcuccuuuaaaggaaauuccuccugccgacauccccaaaaauaaaaaacuucuaacugauggcuaugcuugugaaguuagaugccaaaauaucuacuuaacuacagguuaugcuggcagcaagaauggguccagggaucgagcuacagagcuagcuguaaaacucuugcagaaacguauugaaguuagaguuguccggcggaaauucaagcauacauuuggagaggaccucguggugugucagauuggcauguccuccuaugaauuuccuccagcucugaagccaccagaagaccugguggugcuggguaaagaugcuuccgggcagccaauuuuuaaugcuucugccaaacacuggaccaauuuugucauuacagaaaaugcaaaugaugcaauugguauccuuaacaauucugccucauucaacaagaugucaauugaauacaaauaugagaugaugccaaaucgcacauggcguugucgaguguuuuuacaagaucacugcuuagcugaagguuauggaaccaagaaaacaaguaaacaugcagcugccgacgaggcuuugaaaauucuucaaaaaacacagcccacuuauccaucugucaaaaguucacaaugccauacaggcucuucacccagaggaucuggaaagaagaaagauauaaaggaucuuguaguuuaugagaauucuucaaaucccgugugcacgcugaacgacacagcucaguuuaaccgaaugacaguugaguaugucuaugaaaggaugacaggccuccgcuggaaaugcaaagugauucuagagagugaaguaauugcagaagcaguuggggugaagaaaacugucaaauaugaagcugcuggggaagcugugaaaacccucaaaaagacccagccaacugucauuaacaacuugaagaaaggagcuguugaagaugugauuucaagaaaugaaauucagggccgcucagcagaggaggcuuacaaacagcaaaucaaagaagauaauauuggaaaucagcugcugagaaagauggguuggacugguggugguuuagguaaaucuggugagggcauacgggagccuaucucagugaaagagcagcauaagcgggaagggcuuggucuggauguagagagggugaauaaaauugccaagagagauauugaacagaucaucagaaacuacgcccgcuccgagagccacacagauuugacuuucucuagagagcugacuaaugaugaacggaagcaaauacaucagauugcccagaaguauggucuuaagaguaagucucauggggugggccaugauagguaccuagugguagguagaaaaagacggaaggaagaccuacuagaucagcucaaacaggaaggccaagugggccauuacgagcuuguuaugccucaagcaaauuga

SEQ ID NO: 9125 - RNA, 2073 nt, Artificial Sequence
  derived and/or modified sequence opt1 from NF-kappaB__Homo_sapiens__ABN11235
auggagaagauccugcagauggccgagggcaucgacaucggggagaugcccagcuacgaccucgugcuguccaagccgagcaagggccagaagcgccaccuguccacgugcgacgggcagaacccgcccaagaagcaggccggcagcaaguuccacgcgcggccccgcuucgagcccguccacuucguggccuccagcuccaaggacgagcggcaggaggaccccuacgggccccagaccaaggaggugaacgagcagacccacuucgccagcaugccccgcgacaucuaccaggacuacacccaggacuccuucagcauccaggacggcaacucccaguacugcgacagcuccggcuucauccucaccaaggaccagccggucaccgccaacauguacuucgacagcgggaaccccgcccccuccacgaccagccagcaggcgaacucccagagcacccccgagccgucccccagccagaccuuccccgagagcgugguggccgagaagcaguacuucaucgagaagcugacggccaccaucuggaagaaccuguccaaccccgagaugaccagcggcuccgacaagaucaacuacaccuacaugcucacgcggugcauccaggccugcaagaccaacccggaguacaucuacgcgccccugaaggagaucccgcccgccgacauccccaagaacaagaagcugcucaccgacggguacgccugcgagguccgcugccagaacaucuaccugaccacgggcuacgccgggagcaagaacggcucccgggaccgcgccaccgagcuggcggugaagcuccugcagaagcggaucgaggugcgcgucgugcggcgcaaguucaagcacaccuucggcgaggaccugguggucugccagaucgggaugagcuccuacgaguucccgcccgcccucaagccgcccgaggaccugguggugcugggcaaggacgccagcgggcagcccaucuucaacgccuccgccaagcacuggaccaacuucgucaucacggagaacgcgaacgacgccaucggcauccucaacaacagcgccuccuucaacaagaugagcaucgaguacaaguacgagaugaugcccaaccggaccuggcgcugccggguguuccugcaggaccacugccuggccgagggcuacgggaccaagaagaccuccaagcacgccgcggccgacgaggcccucaagauccugcagaagacgcagcccaccuaccccagcgugaaguccagccagugccacaccggcuccagcccccgcggguccggcaagaagaaggacaucaaggaccuggucguguacgagaacagcagcaaccccgugugcacccucaacgacacggcccaguucaaccggaugaccgucgaguacguguacgagcgcaugaccgggcugcgguggaagugcaaggugauccuggaguccgaggucaucgccgaggcggugggcgucaagaagaccgugaaguacgaggccgccggcgaggccgugaagacgcucaagaagacccagccgaccgucaucaacaaccugaagaagggggcgguggaggacgugaucagccgcaacgagauccagggccgguccgccgaggaggccuacaagcagcagaucaaggaggacaacaucgggaaccagcugcuccgcaagaugggcuggaccgggggcggccugggcaagagcggggaggggauccgcgagcccaucuccgucaaggagcagcacaagcgggagggccuggggcucgacguggagcgcgugaacaagaucgccaagcgggacaucgagcagaucauccgcaacuacgcccggagcgagucccacacggaccugaccuucagccgcgagcugaccaacgacgagcggaagcagauccaccagaucgcgcagaaguacggccucaaguccaagagccacggcgucgggcacgaccgcuaccugguggugggccggaagcgccggaaggaggaccugcucgaccagcugaagcaggaggggcaggucggccacuacgagcuggugaugccccaggccaacuga

SEQ ID NO: 9126 - RNA, 2073 nt, Artificial Sequence
  derived and/or modified sequence opt2 from NF-kappaB__Homo_sapiens__ABN11235
auggagaagauccuccagauggccgagggcaucgacaucggcgagaugcccuccuacgaccucguccucuccaagcccuccaagggccagaagcgccaccucuccaccugcgacggccagaacccccccaagaagcaggccggcuccaaguuccacgcccgcccccgcuucgagcccguccacuucgucgccuccuccuccaaggacgagcgccaggaggaccccuacggcccccagaccaaggaggucaacgagcagacccacuucgccuccaugccccgcgacaucuaccaggacuacacccaggacuccuucuccauccaggacggcaacucccaguacugcgacuccuccggcuucauccucaccaaggaccagcccgucaccgccaacauguacuucgacuccggcaaccccgcccccuccaccaccucccagcaggccaacucccaguccacccccgagcccucccccucccagaccuuccccgaguccgucgucgccgagaagcaguacuucaucgagaagcucaccgccaccaucuggaagaaccucuccaaccccgagaugaccuccggcuccgacaagaucaacuacaccuacaugcucacccgcugcauccaggccugcaagaccaaccccgaguacaucuacgccccccucaaggagaucccccccgccgacauccccaagaacaagaagcuccucaccgacggcuacgccugcgagguccgcugccagaacaucuaccucaccaccggcuacgccggcuccaagaacggcucccgcgaccgcgccaccgagcucgccgucaagcuccuccagaagcgcaucgagguccgcgucguccgccgcaaguucaagcacaccuucggcgaggaccucgucgucugccagaucggcauguccuccuacgaguucccccccgcccucaagccccccgaggaccucgucguccucggcaaggacgccuccggccagcccaucuucaacgccuccgccaagcacuggaccaacuucgucaucaccgagaacgccaacgacgccaucggcauccucaacaacuccgccuccuucaacaagauguccaucgaguacaaguacgagaugaugcccaaccgcaccuggcgcugccgcgucuuccuccaggaccacugccucgccgagggcuacggcaccaagaagaccuccaagcacgccgccgccgacgaggcccucaagauccuccagaagacccagcccaccuaccccuccgucaaguccucccagugccacaccggcuccuccccccgcggcuccggcaagaagaaggacaucaaggaccucgucgucuacgagaacuccuccaaccccgucugcacccucaacgacaccgcccaguucaaccgcaugaccgucgaguacgucuacgagcgcaugaccggccuccgcuggaagugcaaggucauccucgaguccgaggucaucgccgaggccgucggcgucaagaagaccgucaaguacgaggccgccggcgaggccgucaagacccucaagaagacccagcccaccgucaucaacaaccucaagaagggcgccgucgaggacgucaucucccgcaacgagauccagggccgcuccgccgaggaggccuacaagcagcagaucaaggaggacaacaucggcaaccagcuccuccgcaagaugggcuggaccggcggcggccucggcaaguccggcgagggcauccgcgagcccaucuccgucaaggagcagcacaagcgcgagggccucggccucgacgucgagcgcgucaacaagaucgccaagcgcgacaucgagcagaucauccgcaacuacgcccgcuccgagucccacaccgaccucaccuucucccgcgagcucaccaacgacgagcgcaagcagauccaccagaucgcccagaaguacggccucaaguccaagucccacggcgucggccacgaccgcuaccucgucgucggccgcaagcgccgcaaggaggaccuccucgaccagcucaagcaggagggccaggucggccacuacgagcucgucaugccccaggccaacuga

SEQ ID NO: 9127 - RNA, 2073 nt, Artificial Sequence
  derived and/or modified sequence opt3 from NF-kappaB__Homo_sapiens__ABN11235
auggagaagauccugcagauggccgaaggcauugacauaggggagaugcccagcuacgaucucgugcuuuccaaaccuucuaagggacagaaaagacaccugucaaccugcgacggucaaaacccaccgaagaaacaggcuggcaguaaguuccaugcaaggccccgguuugaaccuguccacuucguugccagcuccucuaaggaugagcgccaggaagacccauaugggccccaaacaaaagaggugaaugagcagacucauuuugcgucgaugccucgagauaucuaccaggacuauacgcaggauucauucagcauucaagacggaaacagucaguacugugauuccucuggcuuuaucuugaccaaggaccagccaguaacagcuaauauguauuucgauagcgguaaccccgccccuuccacuaccucacagcaagcaaauagucagagcacaccagaaccgucucccucccagaccuuuccugagucaguggucgccgaaaaacaauacuucauugagaaguuaacugcuacaaucuggaaaaaccugagcaauccagagaugaccagugggucugacaagauaaacuauacguacaugcuaacucguugcauccaggcauguaagaccaaucccgaauacauuuaugccccucucaaagagaucccacccgcugauauuccgaagaacaaaaagcugcuuacagacggauacgccugcgaagugagaugucagaauaucuaucugacuaccggcuacgcgggcuccaaaaacgggagcagggaccgggcaacagaguuggccguuaagcuccugcagaaacgcauagaagugagagucgugaggcggaaguuuaagcacaccuucggagaggaucugguaguuugccaaauugguaugucgucuuaugaguuuccucccgcucucaaaccaccugaagacuuagugguccugggcaaggaugccuccgggcagcccaucuucaaugcaucagcuaaacauuggacgaacuuugugauuacugagaaugccaacgacgcgaucggaauccuuaacaauagugccagcuucaacaagauguccauugaauacaaauaugagaugaugccaaaucgcacauggcgauguagaguguucuugcaggaucacugccuggcagaaggcuacgguaccaagaagacuucuaaacacgcugccgcugacgaggcccuaaagauacuccagaaaacacaacccaccuacccuagcgucaagucaagucagugucauacgggguccagcccaaggggaucuggcaaaaagaaggauaucaaagaccugguuguguaugagaacucaaguaauccgguaugcacccuuaacgauacagcacaguuuaaucggaugacuguggaauacgucuaugagcguaugaccggccugcgcuggaaguguaaagugauuuuggaaagcgagguuaucgccgaagcugugggggucaagaaaacagugaaguacgaggcggcaggagaggccguaaagacucucaaaaagacccagcccacaguuauaaacaaucugaaaaagggugcuguggaagacgucauuuccagaaacgagauccaaggcaggucugccgaagaggcauauaaacagcagaucaaggaggauaauauugggaaccaguuacugcggaaaaugggauggaccggcggugggcucggcaagucgggagaaggcauccgagagccuauuagcgugaaggaacaacacaaacgcgaggggcuuggacuggacgucgaaagagugaauaagauagccaaaagggacaucgagcagauuauccggaacuacgcucgcuccgagucacauacugauuugacguucaguagagaacuaacaaaugacgagaggaagcagauccaccaaauugcccagaaauauggucugaagucuaagagccacggcguugggcaugaucguuaccucgugguaggacggaaacgaagaaaggaagaccugcuugaucagcugaaacaggagggccaagucggucacuacgaauuggugaugccacaggcaaacuga

SEQ ID NO: 9128 - RNA, 2073 nt, Artificial Sequence
  derived and/or modified sequence opt4 from NF-kappaB__Homo_sapiens__ABN11235
auggagaagauccugcagauggccgagggcaucgacaucggcgagaugcccagcuacgaccuggugcugagcaagcccagcaagggccagaagagacaccugagcaccugcgacggccagaacccccccaagaagcaggccggcagcaaguuccacgccagacccagauucgagcccgugcacuucguggccagcagcagcaaggacgagagacaggaggaccccuacggcccccagaccaaggaggugaacgagcagacccacuucgccagcaugcccagagacaucuaccaggacuacacccaggacagcuucagcauccaggacggcaacagccaguacugcgacagcagcggcuucauccugaccaaggaccagcccgugaccgccaacauguacuucgacagcggcaaccccgcccccagcaccaccagccagcaggccaacagccagagcacccccgagcccagccccagccagaccuuccccgagagcgugguggccgagaagcaguacuucaucgagaagcugaccgccaccaucuggaagaaccugagcaaccccgagaugaccagcggcagcgacaagaucaacuacaccuacaugcugaccagaugcauccaggccugcaagaccaaccccgaguacaucuacgccccccugaaggagaucccccccgccgacauccccaagaacaagaagcugcugaccgacggcuacgccugcgaggugagaugccagaacaucuaccugaccaccggcuacgccggcagcaagaacggcagcagagacagagccaccgagcuggccgugaagcugcugcagaagagaaucgaggugagaguggugagaagaaaguucaagcacaccuucggcgaggaccugguggugugccagaucggcaugagcagcuacgaguucccccccgcccugaagccccccgaggaccugguggugcugggcaaggacgccagcggccagcccaucuucaacgccagcgccaagcacuggaccaacuucgugaucaccgagaacgccaacgacgccaucggcauccugaacaacagcgccagcuucaacaagaugagcaucgaguacaaguacgagaugaugcccaacagaaccuggagaugcagaguguuccugcaggaccacugccuggccgagggcuacggcaccaagaagaccagcaagcacgccgccgccgacgaggcccugaagauccugcagaagacccagcccaccuaccccagcgugaagagcagccagugccacaccggcagcagccccagaggcagcggcaagaagaaggacaucaaggaccuggugguguacgagaacagcagcaaccccgugugcacccugaacgacaccgcccaguucaacagaaugaccguggaguacguguacgagagaaugaccggccugagauggaagugcaaggugauccuggagagcgaggugaucgccgaggccgugggcgugaagaagaccgugaaguacgaggccgccggcgaggccgugaagacccugaagaagacccagcccaccgugaucaacaaccugaagaagggcgccguggaggacgugaucagcagaaacgagauccagggcagaagcgccgaggaggccuacaagcagcagaucaaggaggacaacaucggcaaccagcugcugagaaagaugggcuggaccggcggcggccugggcaagagcggcgagggcaucagagagcccaucagcgugaaggagcagcacaagagagagggccugggccuggacguggagagagugaacaagaucgccaagagagacaucgagcagaucaucagaaacuacgccagaagcgagagccacaccgaccugaccuucagcagagagcugaccaacgacgagagaaagcagauccaccagaucgcccagaaguacggccugaagagcaagagccacggcgugggccacgacagauaccugguggugggcagaaagagaagaaaggaggaccugcuggaccagcugaagcaggagggccaggugggccacuacgagcuggugaugccccaggccaacuga

SEQ ID NO: 9129 - RNA, 2073 nt, Artificial Sequence
  derived and/or modified sequence opt5 from NF-kappaB__Homo_sapiens__ABN11235
auggagaagauccugcagauggccgaaggcauugacaucggggagaugcccagcuacgaucucgugcuguccaaaccuucuaagggacagaaaagacaccuuagcacaugcgacggccaaaacccgcccaagaaacaggcuggguccaaguuccaugcccggccucgcuuugaacccguccacuucguugcgucuagcuccaaggaugagagacaggaagacccuuauggaccccaaaccaaagaggugaaugagcagacgcauuuugcuucuaugccucgggauauuuaccaggacuauacccaggauagcuucuccauccaagacggcaacagccaguacugugauucuuccggguuuauucugacaaaggaccagccggugaccgccaauauguauuucgauagcggaaaccccgccccuucuacaaccucccagcaagcuaauagccagucuacacccgaaccuucccccagccagaccuuuccggaguccgucguggccgaaaaacaauacuucaucgagaagcucacggcuaccaucuggaaaaaccugucuaauccugagaugacaagcggcuccgacaagauuaacuauaccuacaugcuuacacgcugcauccaggccuguaagaccaaucccgaauacauuuaugcgccucugaaagagaucccucccgccgauauucccaagaacaaaaagcuccugacggacggcuacgcuugcgaaguuagaugucagaauaucuaucugacaaccggguacgccggaagcaaaaacggcucucgggaccgcgcuacagagcucgccgugaagcugcuucagaaaagaauugaaguccgggugguucgcagaaaguuuaagcacaccuucggggaggaucugguggucugccaaaucggaauguccagcuaugaguuuccgcccgcgcucaaaccucccgaagaccugguggugcuuggcaaggaugccucugggcagccuaucuucaaugcuagcgccaaacauuggaccaacuuugucauuacagagaaugcuaacgacgccaucggcauucugaacaauuccgccucuuucaacaagaugagcaucgaauacaaauaugagaugaugcccaaucggacguggcgcuguagaguuuuccuccaggaucacugccuggcugaaggauacggcaccaagaagacauccaaacacgcggccgcugacgaggcccugaagauucuccagaaaacccaaccgacauacccuagcgugaagucuucccagugucauaccgggagcucuccccggggauccggcaaaaagaaggauaucaaagaccugguggucuaugagaacagcuccaauccugugugcacgcuuaacgauacagcccaguuuaaucgcaugaccguugaauacguguaugagagaaugaccgggcugcgguggaaguguaaagucauccucgaaucugaggugauugcugaagccguuggagugaagaaaacagucaaguacgaggcggcuggcgaggccgugaagacccugaaaaagacacagcccacggucaucaacaaucuuaaaaagggggccguggaagacguuauuagcagaaacgagauccaaggacgcuccgcugaagaggccuauaaacagcagauuaaggaggauaauaucggcaaccagcugcuccggaaaaugggcuggaccgggggaggccuggggaagucuggagaaggcaucagagagccuauuagcgugaaggaacaacacaaacgcgaggggcugggccucgacgucgaacgggugaauaagaucgcuaaaagagacauugagcagaucauucgcaacuacgcccgguccgagagccauacagaucugaccuucucuagagaacuuacaaaugacgagcgcaagcagauccaccaaauugcgcagaaauauggacugaaguccaagagccacggcguugggcaugaucgguaccucguggucggaagaaaacgccggaaggaagaccugcuugaucagcugaaacaggagggccaaguggggcacuacgaacucgugaugccccaggccaacuga

SEQ ID NO: 9130 - protein, 975 aa, Artificial Sequence
  NLRP14__Homo_sapiens__Q86UT6
MRWGHHLPRASWGSGFRRALQRPDDRIPFLIHWSWPLQGERPFGPPRAFIRHHGSSVDSAPPPGRHGRLFPSASATEAIQRHRRNLAEWFSRLPREERQFGPTFALDTVHVDPVIRESTPDELLRPPAELALEHQPPQAGLPPLALSQLFNPDACGRRVQTVVLYGTVGTGKSTLVRKMVLDWCYGRLPAFELLIPFSCEDLSSLGPAPASLCQLVAQRYTPLKEVLPLMAAAGSHLLFVLHGLEHLNLDFRLAGTGLCSDPEEPQEPAAIIVNLLRKYMLPQASILVTTRPSAIGRIPSKYVGRYGEICGFSDTNLQKLYFQLRLNQPYCGYAVGGSGVSATPAQRDHLVQMLSRNLEGHHQIAAACFLPSYCWLVCATLHFLHAPTPAGQTLTSIYTSFLRLNFSGETLDSTDPSNLSLMAYAARTMGKLAYEGVSSRKTYFSEEDVCGCLEAGIRTEEEFQLLHIFRRDALRFFLAPCVEPGRAGTFVFTVPAMQEYLAALYIVLGLRKTTLQKVGKEVAELVGRVGEDVSLVLGIMAKLLPLRALPLLFNLIKVVPRVFGRMVGKSREAVAQAMVLEMFREEDYYNDDVLDQMGASILGVEGPRRHPDEPPEDEVFELFPMFMGGLLSAHNRAVLAQLGCPIKNLDALENAQAIKKKLGKLGRQVLPPSELLDHLFFHYEFQNQRFSAEVLSSLRQLNLAGVRMTPVKCTVVAAVLGSGRHALDEVNLASCQLDPAGLRTLLPVFLRARKLGLQLNSLGPEACKDLRDLLLHDQCQITTLRLSNNPLTAAGVAVLMEGLAGNTSVTHLSLLHTGLGDEGLELLAAQLDRNRQLQELNVAYNGAGDTAALALARAAREHPSLELLHLYFNELSSEGRQVLRDLGGAAEGGARVVVSLTEGTAVSEYWSVILSEVQRNLNSWDRARVQRHLELLLRDLEDSRGATLNPWRKAQLLRVEGEVRALLEQLGSSGS

SEQ ID NO: 9131 - RNA, 2928 nt, Artificial Sequence
  NLRP14__Homo_sapiens__AAI10891
augagguggggccaccauuugcccagggccucuuggggcucugguuuuagaagagcacuccagcgaccagaugaucguauccccuuccugauccacuggaguuggccccuucaaggggagcgucccuuugggcccccuagggccuuuauacgccaccacggaagcucgguagauagcgcucccccacccgggaggcauggacggcuguuccccagcgccucugcaacugaagcuauacagcggcaccgccggaaccuggcugagugguucagccggcugcccagggaggagcgccaguuuggcccaaccuuugcccuagacacgguccacguugacccugugauccgcgagaguaccccugaugagcuacuucgcccacccgcggagcuggcccuggagcaucagccaccccaggccgggcuccccccacuggccuugucucagcucuuuaacccggaugccugugggcgccgggugcagacaguggugcuguaugggacagugggcacaggcaagagcacgcuggugcgcaagaugguucuggacugguguuaugggcggcugccggccuucgagcugcucauccccuucuccugugaggaccugucaucccugggcccugccccagccucccugugccaacuuguggcccagcgcuacacgccccugaaggagguucugccccugauggcugcugcugggucccaccuccucuuugugcuccauggcuuagagcaucucaaccucgacuuccggcuggcaggcacgggacuuuguagugacccggaggaaccgcaggaaccagcugcuaucaucgucaaccugcugcgcaaauacaugcugccucaggccagcauucuggugaccacucggcccucugccauuggccguauccccagcaaguacgugggccgcuauggugagaucugcgguuucucugauaccaaccugcagaagcucuacuuccagcuccgccucaaccagccguacugcggguaugccguuggcgguucaggugucucugccacaccagcucagcgugaccaccuggugcagaugcucucccggaaccuggaggggcaccaccagauagccgcugccugcuuccugccguccuauugcuggcucguuugugccaccuugcacuuccugcaugcccccacgccugcugggcagacccuuacaagcaucuauaccagcuuccugcgccucaacuucagcggggaaacccuggacagcacugaccccuccaauuugucccugauggccuaugcagcccgaaccaugggcaaguuggccuaugaggggguguccucccgcaagaccuacuucucugaagaggaugucuguggcugccuggaggcuggcaucaggacggaggaggaguuucagcugcugcacaucuuccgucgggaugcccugagguuuuuccuggccccauguguggagccagggcgugcaggcaccuucguguucaccgugcccgccaugcaggaauaccuggcugcccucuacauugugcuggguuugcgcaagacgacccugcaaaaggugggcaaggaaguggcugagcucgugggccguguuggggaggacgucagccugguacugggcaucauggccaagcugcugccucugcgggcucugccucugcucuucaaccugaucaaggugguuccacgaguguuugggcgcaugguggguaaaagccgggaggcgguggcucaggccauggugcuggagauguuucgagaggaggacuacuacaacgaugauguucuggaccagaugggcgccaguauccugggcguggagggcccccggcgccacccagaugagcccccugaggaugaagucuucgagcucuuccccauguucaugggggggcuucucucugcccacaaccgagcugugcuagcucagcuuggcugccccaucaagaaccuggaugcccuggagaaugcccaggccaucaagaagaagcugggcaagcugggccggcaggugcugcccccaucagagcuccuugaccaccucuucuuccacuaugaguuccagaaccagcgcuucuccgcugaggugcucagcucccugcgucagcucaaccuggcaggugugcgcaugacaccagucaagugcacagugguggcagcugugcugggcagcggaaggcaugcccuggaugaggugaacuuggccuccugccagcuagauccugcugggcugcgcacacuccugccugucuuccugcgugcccggaagcugggcuugcaacucaacagccugggcccugaggccugcaaggaccuccgagaccuguugcugcaugaccagugccaaauuaccacacugcggcuguccaacaacccgcugacggcggcagguguugccgugcuaauggaggggcuggcaggaaacaccucagugacgcaccugucccugcugcacacgggccuuggggacgaaggccuggagcugcuggcugcccagcuggaccgcaaccggcagcugcaggagcugaacguggcguacaacggugcuggugacacagcggcccuggcccuggccagagcugcccgggagcacccuucccuggaacugcuacaccucuacuucaaugagcugagcucagagggccgccaggucuugcgagacuuggggggugcugcugaagguggugcccgggugguggugucacugacagaggggacggcggugucagaauacuggucagugauccucagugaaguccagcggaaccucaauagcugggaucgggcccggguucagcgacaccuugagcuccuacugcgggaucuggaagauagccggggugccacccuuaauccuuggcgcaaggcccagcugcugcgaguggagggcgaggucagggcccuccuggagcagcugggaagcucuggaagcuga

SEQ ID NO: 9132 - RNA, 2928 nt, Artificial Sequence
  derived and/or modified sequence opt1 from NLRP14__Homo_sapiens__AAI10891
augcgcuggggccaccaccucccccgggccagcuggggguccggcuuccgccgggcccugcagcgcccggacgaccggauccccuuccugauccacuggagcuggccccugcagggggagcgccccuucggcccgccccgggcguucauccgccaccacggguccagcguggacuccgccccgccgcccggccggcacggccgccucuuccccagcgccuccgccaccgaggccauccagcggcaccgccggaaccuggcggagugguucagccgccugccccgggaggagcgccaguucgggcccaccuucgcccucgacacgguccacguggaccccgugauccgggaguccacccccgacgagcugcugcgcccgcccgccgagcucgcccuggagcaccagccgccccaggcgggccugccgccccucgcccugagccagcuguucaaccccgacgccugcgggcggcgcguccagaccguggugcucuacggcaccgucgggacgggcaaguccacccuggugcggaagauggugcuggacuggugcuacggccgccuccccgccuucgagcugcugauccccuucagcugcgaggaccucuccagccuggggcccgccccggcgucccugugccagcucgucgcccagcgcuacacgccccugaaggaggugcugccccucauggccgccgccggcagccaccuccuguucgugcugcacgggcuggagcaccugaaccucgacuuccggcuggcgggcaccggccugugcuccgaccccgaggagccgcaggagcccgccgccaucaucgucaaccuccugcgcaaguacaugcugccccaggccagcauccucgugaccacccggccguccgccaucgggcgcauccccagcaaguacgugggccgguacggggagaucugcggcuucagcgacaccaaccugcagaagcuguacuuccagcuccgccugaaccagcccuacugcggguacgcggucggcggcuccggggugagcgccacccccgcccagcgggaccaccuggugcagaugcucucccgcaaccuggagggccaccaccagaucgccgccgcgugcuuccugcccagcuacugcuggcucgucugcgccacgcugcacuuccugcacgcccccacccccgccgggcagacccugaccuccaucuacacgagcuuccuccggcugaacuucuccggcgagacccuggacagcaccgaccccuccaaccucagccugauggcguacgccgcccgcaccauggggaagcuggccuacgagggcguguccagccggaagacguacuucuccgaggaggacgugugcggcugccucgaggccgggauccgcaccgaggaggaguuccagcugcugcacaucuuccggcgcgacgcgcuccgguucuuccuggccccgugcgucgagcccggccgcgccgggaccuucguguucaccgugcccgccaugcaggaguaccuggccgcgcucuacaucguccugggccugcggaagacgacccuccagaagguggggaaggaggucgccgagcuggugggccgcgugggcgaggacgucagccuggugcucgggaucauggccaagcugcugccccuccgggcccugccgcuccuguucaaccugaucaagguggucccccgcguguucggccgcaugguggggaagucccgggaggccgucgcgcaggccauggugcuggagauguuccgcgaggaggacuacuacaacgacgacgugcucgaccagaugggcgccagcauccugggcgucgaggggccccggcgccaccccgacgagccgcccgaggacgagguguucgagcuguuccccauguucaugggcgggcuccuguccgcccacaaccgggcggugcuggcccagcucggcugccccaucaagaaccuggacgcccuggagaacgcccaggccaucaagaagaagcucgggaagcugggccgccagguccugccgcccagcgagcuccuggaccaccuguucuuccacuacgaguuccagaaccagcgguucuccgcggaggugcucagcagccugcgccagcugaaccucgccggcgugcggaugacccccgucaagugcaccgugguggccgccguccugggguccggccgccacgcccuggacgaggugaaccucgcgagcugccagcuggaccccgccgggcugcggacgcuccugccgguguuccugcgcgcccggaagcucggccugcagcugaacucccucgggcccgaggccugcaaggaccugcgcgaccugcuccugcacgaccagugccagaucaccacccugcggcucagcaacaacccccugaccgccgcgggcgucgccgugcugauggagggccucgccgggaacacguccgugacccaccugagccugcuccacaccggccugggggacgagggccuggagcuccuggccgcgcagcuggaccgcaaccggcagcuccaggagcugaacgucgccuacaacggggccggcgacaccgccgcccuggcgcucgcccgcgccgcccgggagcacccgucccuggagcugcuccaccuguacuucaacgagcugagcuccgagggccgccaggugcuccgggaccucgggggcgccgcggagggcggggcccgcguggucgugagccugacggaggggaccgccguguccgaguacuggagcgucauccuguccgaggugcagcgcaaccugaacagcugggaccgggcccgcgugcagcggcaccuggagcuccugcugcgcgaccucgaggacucccggggcgccacccugaaccccuggcgcaaggcgcagcugcugcgggucgagggcgaggugcgcgcccuccuggagcagcuggggagcuccggcagcuga

SEQ ID NO: 9133 - RNA, 2928 nt, Artificial Sequence
  derived and/or modified sequence opt2 from NLRP14__Homo_sapiens__AAI10891
augcgcuggggccaccaccucccccgcgccuccuggggcuccggcuuccgccgcgcccuccagcgccccgacgaccgcauccccuuccucauccacugguccuggccccuccagggcgagcgccccuucggccccccccgcgccuucauccgccaccacggcuccuccgucgacuccgcccccccccccggccgccacggccgccucuuccccuccgccuccgccaccgaggccauccagcgccaccgccgcaaccucgccgagugguucucccgccucccccgcgaggagcgccaguucggccccaccuucgcccucgacaccguccacgucgaccccgucauccgcgaguccacccccgacgagcuccuccgcccccccgccgagcucgcccucgagcaccagcccccccaggccggccuccccccccucgcccucucccagcucuucaaccccgacgccugcggccgccgcguccagaccgucguccucuacggcaccgucggcaccggcaaguccacccucguccgcaagaugguccucgacuggugcuacggccgccuccccgccuucgagcuccucauccccuucuccugcgaggaccucuccucccucggccccgcccccgccucccucugccagcucgucgcccagcgcuacaccccccucaaggagguccucccccucauggccgccgccggcucccaccuccucuucguccuccacggccucgagcaccucaaccucgacuuccgccucgccggcaccggccucugcuccgaccccgaggagccccaggagcccgccgccaucaucgucaaccuccuccgcaaguacaugcucccccaggccuccauccucgucaccacccgccccuccgccaucggccgcauccccuccaaguacgucggccgcuacggcgagaucugcggcuucuccgacaccaaccuccagaagcucuacuuccagcuccgccucaaccagcccuacugcggcuacgccgucggcggcuccggcgucuccgccacccccgcccagcgcgaccaccucguccagaugcucucccgcaaccucgagggccaccaccagaucgccgccgccugcuuccuccccuccuacugcuggcucgucugcgccacccuccacuuccuccacgcccccacccccgccggccagacccucaccuccaucuacaccuccuuccuccgccucaacuucuccggcgagacccucgacuccaccgaccccuccaaccucucccucauggccuacgccgcccgcaccaugggcaagcucgccuacgagggcgucuccucccgcaagaccuacuucuccgaggaggacgucugcggcugccucgaggccggcauccgcaccgaggaggaguuccagcuccuccacaucuuccgccgcgacgcccuccgcuucuuccucgcccccugcgucgagcccggccgcgccggcaccuucgucuucaccguccccgccaugcaggaguaccucgccgcccucuacaucguccucggccuccgcaagaccacccuccagaaggucggcaaggaggucgccgagcucgucggccgcgucggcgaggacgucucccucguccucggcaucauggccaagcuccucccccuccgcgcccucccccuccucuucaaccucaucaaggucgucccccgcgucuucggccgcauggucggcaagucccgcgaggccgucgcccaggccaugguccucgagauguuccgcgaggaggacuacuacaacgacgacguccucgaccagaugggcgccuccauccucggcgucgagggcccccgccgccaccccgacgagccccccgaggacgaggucuucgagcucuuccccauguucaugggcggccuccucuccgcccacaaccgcgccguccucgcccagcucggcugccccaucaagaaccucgacgcccucgagaacgcccaggccaucaagaagaagcucggcaagcucggccgccagguccucccccccuccgagcuccucgaccaccucuucuuccacuacgaguuccagaaccagcgcuucuccgccgagguccucuccucccuccgccagcucaaccucgccggcguccgcaugacccccgucaagugcaccgucgucgccgccguccucggcuccggccgccacgcccucgacgaggucaaccucgccuccugccagcucgaccccgccggccuccgcacccuccuccccgucuuccuccgcgcccgcaagcucggccuccagcucaacucccucggccccgaggccugcaaggaccuccgcgaccuccuccuccacgaccagugccagaucaccacccuccgccucuccaacaacccccucaccgccgccggcgucgccguccucauggagggccucgccggcaacaccuccgucacccaccucucccuccuccacaccggccucggcgacgagggccucgagcuccucgccgcccagcucgaccgcaaccgccagcuccaggagcucaacgucgccuacaacggcgccggcgacaccgccgcccucgcccucgcccgcgccgcccgcgagcaccccucccucgagcuccuccaccucuacuucaacgagcucuccuccgagggccgccagguccuccgcgaccucggcggcgccgccgagggcggcgcccgcgucgucgucucccucaccgagggcaccgccgucuccgaguacugguccgucauccucuccgagguccagcgcaaccucaacuccugggaccgcgcccgcguccagcgccaccucgagcuccuccuccgcgaccucgaggacucccgcggcgccacccucaaccccuggcgcaaggcccagcuccuccgcgucgagggcgagguccgcgcccuccucgagcagcucggcuccuccggcuccuga

SEQ ID NO: 9134 - RNA, 2928 nt, Artificial Sequence
  derived and/or modified sequence opt3 from NLRP14__Homo_sapiens__AAI10891
augagauggggccaccaucugcccagggccagcuggggguccggauuccggcgcgcucuccagcgaccugacgaucguaucccauuucuuauucacuggucuuggccgcugcaaggugagagacccuucggcccuccaagggcauuuauacggcaucacgggucaaguguggacagcgcacccccuccaggacgccauggcagauuguuccccuccgcgucugcuaccgaagccauccagaggcaccggcgcaacuuagcagagugguuuucgcgacugccuagagaagagaggcaguucgguccaacauuugcccuagauacuguccacguugacccggugauucgggaaucaacgcccgaugagcuccugcguccuccagcugagcuugcacuggaacaucagcccccucaagccggguugccaccccucgcucugagccagcuguucaauccggacgccugcggacgcagaguacagaccgugguccucuacggcacagugggcacugggaagaguaccuuaguuaggaaaauggugcuggauugguguuauggacggcuuccugcguuugaguugcugauccccuucuccugcgaagaccuaucuagccucgguccagccccugccucccugugucagcuugucgcucaacgauacacaccccugaaggagguguugccacucauggccgcagcuggcucacaccuguuauuuguacugcaugggcucgagcaccuuaaccuggauuuccgcuuggccggaaccggccuaugcagugaccccgaggaaccucaggaaccagcggccauuaucguuaaucugcucagaaaauauaugcugccgcaggcaagcauacuugugacuacaaggcccucugcuaucggucggauuccuuccaaguacgucgggcgcuauggagagaucuguggcuuuucagauaccaaccugcagaaauuguacuuccaacucagacugaaucagccauauugcggcuacgccgucgggggaagcggugugagugcuacgcccgcccagagggaccacuuagugcaaaugcugucucguaaccuagaaggccaucaccagauugcagccgcuuguuuccucccuuccuacugcuggcugguuugugcgacucuucacuuuuugcaugcaccaacccccgccgggcagacacugacuagcaucuauaccucguuccuccggcugaauuuuucuggagagacacuugauuccaccgacccgucaaaccugaguuugauggcuuacgccgcacgaacgaugggcaagcucgccuaugagggugugagcuccagaaagacuuacuucucugaagaggacguaugcgggugucuggaagcuggcauaaggacagaggaagaguuucaguuacugcauauuuuccgccgggaugcccuaagauuuuuccucgcaccuugcguggagccaggaagggcgggcaccuuugucuucacugugcccgcuaugcaagaauaucuggccgcacuuuacaucguuuuggggcugcgcaaaacaacccuccagaaggugggaaaagaggucgccgaacuggugggucgaguaggcgaggacguuagcuuagugcuggggauuauggcuaaacuuuugccucuccgggcccugccccuacuguuuaaucucaucaaagucgugccacgugucuucggaagaauggugggcaagucaagggaagcaguugcucaggccauggugcuggagauguuucgcgaggaagauuauuacaacgacgauguacuugaccagaugggugcgaguaucuugggggucgagggcccucggagacaccccgaugaaccaccggaggacgagguguucgaacuguucccuauguuuaugggaggcuuacucuccgcccacaauagggcuguucuggcacaacuugggugccccauuaagaaccuggaugccuuggagaaugcucaggccauaaagaagaaacucggaaagcugggucgacaggugcuaccacccagcgaacugcucgaccaucuguucuuucacuacgaguuccagaaccaacgcuuuucugcagaaguccuuucaaguuugcggcagcugaauuuagcgggcgugagaaugacgccuguaaaauguaccgugguugccgcuguccucgggagcggaaggcaugcccuggaugaggugaaccuugcauccugccagcuggacccagcuggccuacguacacuccugcccguguucuugcgcgcccggaagcuggguuuacagcucaacucucuggggccugaggcauguaaagaccuuagagaucuguugcuccacgaccaaugccagaucacuacccugaggcuaucgaauaacccgcugacagccgcuggcgucgcgguucuuauggaaggacucgccggcaauacuagcgugacccaccuguccuugcugcauacaggguuaggagaugagggccucgaacugcuugcagcucagcuggaccgaaaccggcaauugcaggagcucaauguggccuauaacggugccggggauaccgcugcacuggcccuagcgcgcgcugccagagaacacccaucacuggagcuucuccaucuguacuuuaaugaguugaguucugaaggaaggcagguauuacgggaccugggcggugcagccgagggcggggcucgagucgugguuagccucacugaaggaacggcaguguccgaguauuggucagucauucugagcgaagugcagagaaaccuuaauucuugggaucgcgccaggguucaacgucaccuggaguugcuacugcgggaccucgaggauuccagaggcgcgacacugaaccccuggaggaaggcucagcuuuuacgcguggaaggggagguacgagcccugcucgaacaguugggaaguagcggcucuuga

SEQ ID NO: 9135 - RNA, 2928 nt, Artificial Sequence
  derived and/or modified sequence opt4 from NLRP14__Homo_sapiens__AAI10891
augagauggggccaccaccugcccagagccagcuggggcagcggcuucagaagagcccugcagagacccgacgacagaauccccuuccugauccacuggagcuggccccugcagggcgagagacccuucggcccccccagagccuucaucagacaccacggcagcagcguggacagcgcccccccccccggcagacacggcagacuguuccccagcgccagcgccaccgaggccauccagagacacagaagaaaccuggccgagugguucagcagacugcccagagaggagagacaguucggccccaccuucgcccuggacaccgugcacguggaccccgugaucagagagagcacccccgacgagcugcugagaccccccgccgagcuggcccuggagcaccagcccccccaggccggccugcccccccuggcccugagccagcuguucaaccccgacgccugcggcagaagagugcagaccguggugcuguacggcaccgugggcaccggcaagagcacccuggugagaaagauggugcuggacuggugcuacggcagacugcccgccuucgagcugcugauccccuucagcugcgaggaccugagcagccugggccccgcccccgccagccugugccagcugguggcccagagauacaccccccugaaggaggugcugccccugauggccgccgccggcagccaccugcuguucgugcugcacggccuggagcaccugaaccuggacuucagacuggccggcaccggccugugcagcgaccccgaggagccccaggagcccgccgccaucaucgugaaccugcugagaaaguacaugcugccccaggccagcauccuggugaccaccagacccagcgccaucggcagaauccccagcaaguacgugggcagauacggcgagaucugcggcuucagcgacaccaaccugcagaagcuguacuuccagcugagacugaaccagcccuacugcggcuacgccgugggcggcagcggcgugagcgccacccccgcccagagagaccaccuggugcagaugcugagcagaaaccuggagggccaccaccagaucgccgccgccugcuuccugcccagcuacugcuggcuggugugcgccacccugcacuuccugcacgcccccacccccgccggccagacccugaccagcaucuacaccagcuuccugagacugaacuucagcggcgagacccuggacagcaccgaccccagcaaccugagccugauggccuacgccgccagaaccaugggcaagcuggccuacgagggcgugagcagcagaaagaccuacuucagcgaggaggacgugugcggcugccuggaggccggcaucagaaccgaggaggaguuccagcugcugcacaucuucagaagagacgcccugagauucuuccuggcccccugcguggagcccggcagagccggcaccuucguguucaccgugcccgccaugcaggaguaccuggccgcccuguacaucgugcugggccugagaaagaccacccugcagaaggugggcaaggagguggccgagcuggugggcagagugggcgaggacgugagccuggugcugggcaucauggccaagcugcugccccugagagcccugccccugcuguucaaccugaucaagguggugcccagaguguucggcagaauggugggcaagagcagagaggccguggcccaggccauggugcuggagauguucagagaggaggacuacuacaacgacgacgugcuggaccagaugggcgccagcauccugggcguggagggccccagaagacaccccgacgagccccccgaggacgagguguucgagcuguuccccauguucaugggcggccugcugagcgcccacaacagagccgugcuggcccagcugggcugccccaucaagaaccuggacgcccuggagaacgcccaggccaucaagaagaagcugggcaagcugggcagacaggugcugccccccagcgagcugcuggaccaccuguucuuccacuacgaguuccagaaccagagauucagcgccgaggugcugagcagccugagacagcugaaccuggccggcgugagaaugacccccgugaagugcaccgugguggccgccgugcugggcagcggcagacacgcccuggacgaggugaaccuggccagcugccagcuggaccccgccggccugagaacccugcugcccguguuccugagagccagaaagcugggccugcagcugaacagccugggccccgaggccugcaaggaccugagagaccugcugcugcacgaccagugccagaucaccacccugagacugagcaacaacccccugaccgccgccggcguggccgugcugauggagggccuggccggcaacaccagcgugacccaccugagccugcugcacaccggccugggcgacgagggccuggagcugcuggccgcccagcuggacagaaacagacagcugcaggagcugaacguggccuacaacggcgccggcgacaccgccgcccuggcccuggccagagccgccagagagcaccccagccuggagcugcugcaccuguacuucaacgagcugagcagcgagggcagacaggugcugagagaccugggcggcgccgccgagggcggcgccagagugguggugagccugaccgagggcaccgccgugagcgaguacuggagcgugauccugagcgaggugcagagaaaccugaacagcugggacagagccagagugcagagacaccuggagcugcugcugagagaccuggaggacagcagaggcgccacccugaaccccuggagaaaggcccagcugcugagaguggagggcgaggugagagcccugcuggagcagcugggcagcagcggcagcuga

SEQ ID NO: 9136 - RNA, 2928 nt, Artificial Sequence
  derived and/or modified sequence opt5 from NLRP14__Homo_sapiens__AAI10891
augagauggggccaccaucugccccgggccagcuggggguccggauuccgcagagcucuccagcggccugacgaucgcaucccguuucugauucacuggucuuggccccuucaaggcgagagaccuuucgggcccccucgggccuuuauccgccaucacggaagcuccguggacucugcgcccccuccgggcagacaugggcggcuguuccccagcgcuuccgccaccgaagccauucagcgccacagacggaaccucgcugagugguuuucucgccugccuagagaagaacggcaguucggacccacauuugcccuugauacgguccacguugacccugugauccgcgaaagcacccccgaugagcugcucagaccgccugcugagcuggcccuggaacaucagcccccucaagcgggccucccuccccuggcccuuucccagcuguucaaucccgacgcuugcggccggagagugcagacagucgugcucuacgggaccguuggaacaggcaagagcacccuggugcgcaaaaugguccuugauugguguuaugggcggcugccggccuuugagcuccugauucccuucucuugcgaagaccuguccagccucggaccugcucccgccucucugugucagcuuguggcgcaaagauacacaccucugaaggagguucucccccugauggccgcugccggcucccaccuucuguuugugcuccaugggcuggagcaccugaaccucgauuuccgccuggcuggaaccggccuuugcagcgacccggaggagccucaggaacccgccgccaucaucgucaaucugcuccggaaauauaugcugccucaggcuucuauucuugugacgaccagacccuccgcgaucggccgcauuccuagcaaguacguggggcgguauggagagaucuguggcuuuuccgauacaaaccugcagaaacucuacuuccaacugagacugaaucagcccuauugcggguacgccgucggaggcucugggguuagcgcuaccccggcccagcgcgaccaccucgugcaaaugcugucccggaaccuugaaggacaucaccagauugccgcugccuguuuccugccuagcuacugcuggcucgugugugcgacacugcauuuucugcacgcucccacccccgccggccagacgcuuacaucuaucuauaccuccuuccucagacugaauuuuagcggcgagacacuggauucuaccgacccuagcaaccucucccugauggccuacgcugcccgcaccauggggaagcuggcuuaugagggagucucuagccggaagacauacuucuccgaagaggacgugugcggcugucuggaagccgggauuagaacggaggaagaguuucagcuccugcauaucuuccggcgcgaugcgcugagauuuuuccuugccccgugcguugagcccggacgggcuggcaccuuuguguucacagucccugccaugcaagaauaucucgcugcccuguacaucgugcuggggcucagaaaaaccacacugcagaagguuggcaaagagguggcggaacuugucggacgcgugggcgaggacgucagccuggugcucgggauuauggccaagcugcugccccuucgggcucucccucugcuguuuaaucucaucaaaguugugcccagagucuucggacgcauggugggcaagucuagagaagccguugcucaggccauggugcuggagauguuucgggaggaagauuauuacaacgacgauguccuugaccagaugggggccuccauucugggaguggagggcccucgcagacaccccgaugaaccgccugaggacgagguguucgaacucuuccccauguuuaugggcgggcugcugagcgcucacaaucgggcgguucuugcccaacucggaugcccuaucaagaaccuggaugcucuggagaaugcccaggccauuaaaaagaaacucggcaagcuggggcgccagguccuucccccgucugaacugcucgaccaucuguucuuucacuacgaguuccagaaccaaagauuuuccgcugaagugcugagcucccuucggcagcugaaucucgccggagugcgcaugaccccugucaaauguacggugguugcggcugugcugggcucugggagacaugcccucgaugaggucaaccuggccagcugccagcuugaccccgcuggacugcggacacuccugccuguguuccugcgcgccagaaaacuuggccugcagcucaacucccuggggcccgaggcguguaaggaccuccgggaucugcuucugcacgaccaaugccagaucaccacccucagacugucuaauaacccccugacagcugccggcguugccgugcuuauggaaggacuggcuggcaauaccagcgucacacaccucucccugcuccauacggggcugggagaugagggccuugaacugcuggccgcucagcucgaccgcaaccggcaacugcaggagcuuaauguggccuauaacggggcgggagauaccgccgcucuggcccucgcuagagccgcccgcgaacacccuagccuggagcuccugcaucuuuacuuuaaugagcugucuuccgaaggccggcagguucugagagaccucgggggcgcugcggagggaggcgcccgcguggucgugagccugacagaagggaccgcugugucugaguauugguccgucauccuuagcgaaguucagcggaaccuuaauucuugggauagagcccgcgugcaacggcaccucgagcugcuccugagagaccuugaggauagccggggagccacacugaacccguggcgcaaggcucagcugcucagaguggaaggcgagguccgggcccugcuugaacagcugggguccagcggaucuuga

SEQ ID NO: 9137 - protein, 1093 aa, Artificial Sequence
  NLRP14__Homo_sapiens__Q86W24
MADSSSSSFFPDFGLLLYLEELNKEELNTFKLFLKETMEPEHGLTPWNEVKKARREDLANLMKKYYPGEKAWSVSLKIFGKMNLKDLCERAKEEINWSAQTIGPDDAKAGETQEDQEAVLGDGTEYRNRIKEKFCITWDKKSLAGKPEDFHHGIAEKDRKLLEHLFDVDVKTGAQPQIVVLQGAAGVGKTTLVRKAMLDWAEGSLYQQRFKYVFYLNGREINQLKERSFAQLISKDWPSTEGPIEEIMYQPSSLLFIIDSFDELNFAFEEPEFALCEDWTQEHPVSFLMSSLLRKVMLPEASLLVTTRLTTSKRLKQLLKNHHYVELLGMSEDAREEYIYQFFEDKRWAMKVFSSLKSNEMLFSMCQVPLVCWAACTCLKQQMEKGGDVTLTCQTTTALFTCYISSLFTPVDGGSPSLPNQAQLRRLCQVAAKGIWTMTYVFYRENLRRLGLTQSDVSSFMDSNIIQKDAEYENCYVFTHLHVQEFFAAMFYMLKGSWEAGNPSCQPFEDLKSLLQSTSYKDPHLTQMKCFLFGLLNEDRVKQLERTFNCKMSLKIKSKLLQCMEVLGNSDYSPSQLGFLELFHCLYETQDKAFISQAMRCFPKVAINICEKIHLLVSSFCLKHCRCLRTIRLSVTVVFEKKILKTSLPTNTWDGDRITHCWQDLCSVLHTNEHLRELDLYHSNLDKSAMNILHHELRHPNCKLQKLLLKFITFPDGCQDISTSLIHNKNLMHLDLKGSDIGDNGVKSLCEALKHPECKLQTLRLESCNLTVFCCLNISNALIRSQSLIFLNLSTNNLLDDGVQLLCEALRHPKCYLERLSLESCGLTEAGCEYLSLALISNKRLTHLCLADNVLGDGGVKLMSDALQHAQCTLKSLVLRRCHFTSLSSEYLSTSLLHNKSLTHLDLGSNWLQDNGVKLLCDVFRHPSCNLQDLELMGCVLTNACCLDLASVILNNPNLRSLDLGNNDLQDDGVKILCDALRYPNCNIQRLGLEYCGLTSLCCQDLSSALICNKRLIKMNLTQNTLGYEGIVKLYKVLKSPKCKLQVLGLCKEAFDEEAQKLLEAVGVSNPHLIIKPDCNYHNEEDVSWWWCF

SEQ ID NO: 9138 - RNA, 3282 nt, Artificial Sequence
  NLRP14__Homo_sapiens__AAO18165
auggcagauucaucaucaucuucuuucuuuccugauuuugggcugcuauuguauuuggaggagcuaaacaaagaggaauuaaauacauucaaguuauuccuaaaggagaccauggaaccugagcauggccugacacccuggaaugaagugaagaaggccaggcgggaggaccuggccaauuugaugaagaaauauuauccaggagagaaagccuggagugugucucucaaaaucuuuggcaagaugaaccugaaggaucugugugagagagcgaaagaagagaucaacuggucggcccagacuauaggaccagaugaugccaaggcuggagagacacaagaagaucaggaggcagugcugggugauggaacagaauacagaaauagaauaaaggaaaaauuuugcaucacuugggacaagaagucuuuggcuggaaagccugaagauuuccaucauggaauugcagagaaagauagaaaacuguuggaacacuuguucgauguggaugucaaaaccggugcacagccacagaucguggugcuucagggagcugcuggaguugggaaaacaaccuuggugagaaaggcaauguuagauugggcagagggcagucucuaccagcagagguuuaaguauguuuuuuaucucaaugggagagaaauuaaccagcugaaagagagaagcuuugcucaauugauaucaaaggacuggcccagcacagaaggccccauugaagaaaucauguaccagccaaguagccucuuguuuauuauugacaguuucgaugaacugaacuuugccuuugaagaaccugaguuugcacugugcgaagacuggacccaagaacacccaguguccuuccucaugaguaguuugcugaggaaagugaugcucccugaggcauccuuauuggugacaacaagacucacaacuucuaagagacuaaagcaguuguugaagaaucaccauuauguagagcuacuaggaaugucugaggaugcaagagaggaguauauuuaccaguuuuuugaagauaagaggugggccaugaaaguauucaguucacuaaaaagcaaugagaugcuguuuagcaugugccaagucccccuagugugcugggccgcuuguacuugucugaagcagcaaauggagaaggguggugaugucacauugaccugccaaacaaccacagcucuguuuaccugcuauauuucuagcuuguucacaccaguagauggaggcucuccuagucuacccaaccaagcccagcugagaagacugugccaagucgcugccaaaggaauauggacuaugacuuacguguuuuacagagaaaaucucagaaggcuuggguuaacucaaucugaugucucuaguuuuauggacagcaauauuauucagaaggacgcagaguaugaaaacugcuauguguucacccaccuucauguucaggaguuuuuugcagcuauguucuauauguugaaaggcaguugggaagcugggaacccuuccugccagccuuuugaagauuugaagucauuacuucaaagcacaaguuauaaagacccccauuugacacagaugaagugcuuuuuguuuggccuuuugaaugaagaucgaguaaaacaacuggagaggacuuuuaacuguaaaaugucacugaagauaaaaucaaaguuacuucaguguauggaaguauuaggaaacagugacuauucuccaucacagcugggauuucuggaguuguuucacugucuguaugagacucaagauaaagcguuuauaagccaggcaaugagauguuucccaaagguugccauuaauauuugugagaaaauacauuugcuuguaucuucuuucugccuuaagcacugccgguguuugcggaccaucaggcugucuguaacugugguauuugagaagaagauauuaaaaacaagccucccaacuaacacuugggauggugaucgcauuacucacuguuggcaagaucucuguucugugcuucauacaaaugaacacuugagagaauuggaccuguaccauagcaaccuugauaaaucagcaaugaauauccugcaucaugaacuaaggcacccaaacuguaaacuacaaaagcuacuguugaaauuuaucacuuucccugaugguugucaggauaucucuacuucuuugauucauaacaagaaucugaugcaucuugaccuaaaagggagugauauaggggauaauggaguaaagucauugugugaggccuugaaacacccagaguguaaacuacagacucucaggcuggaaucuugcaaccuaacuguauuuuguugucuaaauauaucuaaugcucucaucagaagccagagccugauauuucugaaucugucaaccaauaaucuguuggaugauggagugcagcuuuugugugaggccuuaagacauccaaaguguuaucuagagagacuguccuuagaaagcuguggucucacagaggcuggcugugaguaucuuucuuuggcucucaucagcaauaaaagacugacacauuugugcuuggcagacaaugucuugggugaugguggaguaaagcuuaugagugaugcccugcaacaugcacaauguacucugaagagccuugugcugaggcguugccauuucacuucacuuagcagugaauaucugucaacuucucuucuacacaacaagagccugacgcaucuggaucuaggaucaaacuggcuacaagacaauggagugaagcuucugugugaugucuuucggcauccaagcuguaaucuucaggacuuggaauugaugggcuguguucucacuaaugcauguugucuggaucuggcuucuguuauuuugaauaacccaaaccugaggagccuggaccuugggaacaacgauuugcaggaugauggagugaaaauucugugugaugcuuugagauauccaaacuguaacauucagaggcucggguuggaauacugugguuugacaucucucugcugucaagaucucuccucugcucuuaucugcaacaaaagacugauaaaaaugaaucugacacagaauaccuuaggauaugaaggaauugugaaguuauauaaagucuugaagucuccuaaguguaaacuacaaguucuaggguugugcaaagaggcauuugaugaggaagcccagaagcugcuggaagcugugggaguuagcaauccacacuuaaucauuaagccagauuguaacuaucauaaugaagaagaugugucuugguggugguguuucuga

SEQ ID NO: 9139 - RNA, 3282 nt, Artificial Sequence
  derived and/or modified sequence opt1 from NLRP14__Homo_sapiens__AAO18165
auggccgacagcuccagcuccagcuucuuccccgacuucggccugcuccuguaccuggaggagcucaacaaggaggagcugaacaccuucaagcuguuccucaaggagaccauggagccggagcacgggcugacgcccuggaacgaggugaagaaggcccgccgggaggaccuggcgaaccucaugaagaaguacuaccccggcgagaaggccugguccgucagccugaagaucuucgggaagaugaaccugaaggaccucugcgagcgcgccaaggaggagaucaacugguccgcccagaccaucggccccgacgacgccaaggcgggggagacccaggaggaccaggaggccgugcugggcgacggcaccgaguaccggaaccgcaucaaggagaaguucugcaucacgugggacaagaagucccuggccgggaagccggaggacuuccaccacggcaucgccgagaaggaccggaagcuccuggagcaccuguucgacguggacgucaagaccggggcgcagccccagaucguggugcuccagggcgccgccggggucggcaagaccacccuggugcgcaaggccaugcuggacugggccgagggcagccucuaccagcagcgguucaaguacguguucuaccugaacgggcgcgagaucaaccagcugaaggagcggagcuucgcgcagcucaucuccaaggacuggcccagcacggagggccccaucgaggagaucauguaccagccguccagccugcuguucaucaucgacuccuucgacgagcucaacuucgccuucgaggagcccgaguucgcccugugcgaggacuggacccaggagcaccccgucagcuuccugauguccagccuccugcgcaaggugaugcugcccgaggccucccuccuggugaccacccggcugacgaccagcaagcgccucaagcagcugcugaagaaccaccacuacgucgagcuccuggggaugagcgaggacgcccgggaggaguacaucuaccaguucuucgaggacaagcgcugggcgaugaagguguucuccagccugaaguccaacgagaugcuguucagcaugugccaggugccgcuggucugcugggccgccugcacgugccugaagcagcagauggagaagggcggcgacgugacccugaccugccagaccaccaccgcccucuucacgugcuacaucuccagccuguucacccccguggacgggggcucccccagccuccccaaccaggcccagcugcggcgccugugccaggucgcggccaaggggaucuggaccaugaccuacguguucuaccgggagaaccugcgccggcucggccugacgcaguccgacgugagcuccuucauggacagcaacaucauccagaaggacgccgaguacgagaacugcuacgucuucacccaccuccacgugcaggaguucuucgccgccauguucuacaugcucaagggguccugggaggcgggcaacccgagcugccagcccuucgaggaccugaagucccugcuccagagcaccuccuacaaggacccccaccugacccagaugaagugcuuccuguucggccuccugaacgaggaccgcgugaagcagcuggagcggacguucaacugcaagaugagccucaagaucaaguccaagcugcugcagugcauggagguccucgggaacagcgacuacagccccucccagcugggcuuccuggagcuguuccacugccuguacgagacccaggacaaggccuucaucagccaggccaugcgcugcuucccgaagguggccaucaacaucugcgagaagauccaccuccucgucuccagcuucugccugaagcacugccgcugccugcggaccauccgccucuccgugaccguggucuucgagaagaagauccugaagacgagccugcccaccaacaccugggacggggaccggaucacccacugcuggcaggaccucugcuccgugcugcacacgaacgagcaccuccgcgagcuggaccuguaccacagcaaccuggacaaguccgcgaugaacauccuccaccacgagcugcggcaccccaacugcaagcugcagaagcuccugcugaaguucaucaccuuccccgacggcugccaggacaucagcaccucccucauccacaacaagaaccugaugcaccuggaccucaaggggagcgacaucggcgacaacggcgugaagucccugugcgaggcccugaagcacccggagugcaagcuccagacccugcgccuggagagcugcaaccucaccgucuucugcugccugaacaucuccaacgcccugauccggagccagucccucaucuuccugaaccugagcacgaacaaccuccuggacgacggggugcagcugcucugcgaggcccugcgccaccccaagugcuaccuggagcggcucagccuggaguccugcggccugaccgaggccgggugcgaguaccucagccuggcgcugaucuccaacaagcgccucacccaccugugccuggccgacaacgugcucggcgacgggggcgucaagcugaugagcgacgcccugcagcacgcccagugcacccucaagucccuggugcugcggcgcugccacuucacgagccucuccagcgaguaccuguccaccagccugcuccacaacaagucccugacccaccuggaccucggcagcaacuggcugcaggacaacggggugaagcugcucugcgacgucuuccggcaccccuccugcaaccugcaggaccuggagcucaugggcugcgugcugaccaacgccugcugccuggaccucgcgagcgugauccugaacaaccccaaccugcgcucccucgaccuggggaacaacgaccugcaggacgacggcgucaagauccugugcgacgcccuccgguacccgaacugcaacauccagcgccugggccuggaguacugcgggcucacgagccugugcugccaggaccuguccagcgcccucaucugcaacaagcggcugaucaagaugaaccugacccagaacacccucggcuacgaggggaucgugaagcuguacaaggugcugaagucccccaagugcaagcuccagguccugggccugugcaaggaggccuucgacgaggaggcccagaagcuccuggaggcggugggggugagcaacccccaccugaucaucaagccggacugcaacuaccacaacgaggaggacgucagcuggugguggugcuucuga

SEQ ID NO: 9140 - RNA, 3282 nt, Artificial Sequence
  derived and/or modified sequence opt2 from NLRP14__Homo_sapiens__AAO18165
auggccgacuccuccuccuccuccuucuuccccgacuucggccuccuccucuaccucgaggagcucaacaaggaggagcucaacaccuucaagcucuuccucaaggagaccauggagcccgagcacggccucacccccuggaacgaggucaagaaggcccgccgcgaggaccucgccaaccucaugaagaaguacuaccccggcgagaaggccugguccgucucccucaagaucuucggcaagaugaaccucaaggaccucugcgagcgcgccaaggaggagaucaacugguccgcccagaccaucggccccgacgacgccaaggccggcgagacccaggaggaccaggaggccguccucggcgacggcaccgaguaccgcaaccgcaucaaggagaaguucugcaucaccugggacaagaagucccucgccggcaagcccgaggacuuccaccacggcaucgccgagaaggaccgcaagcuccucgagcaccucuucgacgucgacgucaagaccggcgcccagccccagaucgucguccuccagggcgccgccggcgucggcaagaccacccucguccgcaaggccaugcucgacugggccgagggcucccucuaccagcagcgcuucaaguacgucuucuaccucaacggccgcgagaucaaccagcucaaggagcgcuccuucgcccagcucaucuccaaggacuggcccuccaccgagggccccaucgaggagaucauguaccagcccuccucccuccucuucaucaucgacuccuucgacgagcucaacuucgccuucgaggagcccgaguucgcccucugcgaggacuggacccaggagcaccccgucuccuuccucauguccucccuccuccgcaaggucaugcuccccgaggccucccuccucgucaccacccgccucaccaccuccaagcgccucaagcagcuccucaagaaccaccacuacgucgagcuccucggcauguccgaggacgcccgcgaggaguacaucuaccaguucuucgaggacaagcgcugggccaugaaggucuucuccucccucaaguccaacgagaugcucuucuccaugugccaggucccccucgucugcugggccgccugcaccugccucaagcagcagauggagaagggcggcgacgucacccucaccugccagaccaccaccgcccucuucaccugcuacaucuccucccucuucacccccgucgacggcggcucccccucccuccccaaccaggcccagcuccgccgccucugccaggucgccgccaagggcaucuggaccaugaccuacgucuucuaccgcgagaaccuccgccgccucggccucacccaguccgacgucuccuccuucauggacuccaacaucauccagaaggacgccgaguacgagaacugcuacgucuucacccaccuccacguccaggaguucuucgccgccauguucuacaugcucaagggcuccugggaggccggcaaccccuccugccagcccuucgaggaccucaagucccuccuccaguccaccuccuacaaggacccccaccucacccagaugaagugcuuccucuucggccuccucaacgaggaccgcgucaagcagcucgagcgcaccuucaacugcaagaugucccucaagaucaaguccaagcuccuccagugcauggagguccucggcaacuccgacuacucccccucccagcucggcuuccucgagcucuuccacugccucuacgagacccaggacaaggccuucaucucccaggccaugcgcugcuuccccaaggucgccaucaacaucugcgagaagauccaccuccucgucuccuccuucugccucaagcacugccgcugccuccgcaccauccgccucuccgucaccgucgucuucgagaagaagauccucaagaccucccuccccaccaacaccugggacggcgaccgcaucacccacugcuggcaggaccucugcuccguccuccacaccaacgagcaccuccgcgagcucgaccucuaccacuccaaccucgacaaguccgccaugaacauccuccaccacgagcuccgccaccccaacugcaagcuccagaagcuccuccucaaguucaucaccuuccccgacggcugccaggacaucuccaccucccucauccacaacaagaaccucaugcaccucgaccucaagggcuccgacaucggcgacaacggcgucaagucccucugcgaggcccucaagcaccccgagugcaagcuccagacccuccgccucgaguccugcaaccucaccgucuucugcugccucaacaucuccaacgcccucauccgcucccagucccucaucuuccucaaccucuccaccaacaaccuccucgacgacggcguccagcuccucugcgaggcccuccgccaccccaagugcuaccucgagcgccucucccucgaguccugcggccucaccgaggccggcugcgaguaccucucccucgcccucaucuccaacaagcgccucacccaccucugccucgccgacaacguccucggcgacggcggcgucaagcucauguccgacgcccuccagcacgcccagugcacccucaagucccucguccuccgccgcugccacuucaccucccucuccuccgaguaccucuccaccucccuccuccacaacaagucccucacccaccucgaccucggcuccaacuggcuccaggacaacggcgucaagcuccucugcgacgucuuccgccaccccuccugcaaccuccaggaccucgagcucaugggcugcguccucaccaacgccugcugccucgaccucgccuccgucauccucaacaaccccaaccuccgcucccucgaccucggcaacaacgaccuccaggacgacggcgucaagauccucugcgacgcccuccgcuaccccaacugcaacauccagcgccucggccucgaguacugcggccucaccucccucugcugccaggaccucuccuccgcccucaucugcaacaagcgccucaucaagaugaaccucacccagaacacccucggcuacgagggcaucgucaagcucuacaagguccucaagucccccaagugcaagcuccagguccucggccucugcaaggaggccuucgacgaggaggcccagaagcuccucgaggccgucggcgucuccaacccccaccucaucaucaagcccgacugcaacuaccacaacgaggaggacgucuccuggugguggugcuucuga

SEQ ID NO: 9141 - RNA, 3282 nt, Artificial Sequence
  derived and/or modified sequence opt3 from NLRP14__Homo_sapiens__AAO18165
auggccgacagcuccucuucaaguuucuuucccgauuucggccugcuccuuuaccuggaggaauugaacaaggaggaauuaaauaccuuuaaacuguuccuaaaggagacaauggaaccugagcacgggcucacuccauggaacgaggugaaaaaggcuagaagggaagaccuggcaaaucuuaugaaaaaguauuacccgggagagaaggccuggagcgucucccugaaaaucuuugguaagaugaacuugaaagaucucugcgaacgggcgaaggaggagauuaauuggucugcucagacgauaggccccgacgaugccaaagcaggggaaacccaagaggaccaggaagccguucugggagauggcacagaguaucgcaaccgaaucaaggaaaaguucuguauuacuugggacaaaaagucgcuggcugguaaaccugaggauuuucaucacgggaucgcagagaaggaccguaaacucuuagaacaucuguucgauguggacguaaagaccggagcccagccacagauugugguccuucaaggcgcugccggcguggggaaaacaaccuugguuagaaaggcgaugcuggauugggcagagggaucacuauaccagcagagguuuaaguauguguucuaccucaauggucgggaaaucaaccagcugaaagagcgcagcuuugcccaacuuauaaguaaggacuggcccuccacugaaggcccuaucgaggagauuauguaucagccaucuagccuguuguucaucauugacuccuuugaugaacucaauuucgcuuucgaggaacccgaguuugcccugugcgaagacuggacacaggagcacccugucucauucuuaaugaguagccugcucagaaaagugaugcuuccagaggcaucucuguugguaaccacgaggcuaacuaccuccaagcggcugaaacagcuccugaagaaccaucacuacguugaacuucuggggaugucagaggaugcucgcgaagaguacaucuaucaauuuuucgaggacaagcgaugggccaugaaaguguuuagcaguuugaagucuaaugaaaugcuguucuccaugugucaggucccgcucgugugcugggcggccuguacaugcuuaaaacagcaaauggagaagggaggcgaugugacucugaccugucagacaaccacggcacuauuuacuugcuacauaagcucucucuucacacccgucgacggugggucgccuucccugccaaaccaggcucagcuuagaagguugugucaaguugccgcuaaaggaauuuggaccaugacuuauguguuuuaccgggaaaaucugcgucgccucggccugacacagucagauguaaguagcuucauggacuccaacaucauucagaaggaugccgaguaugaaaauugcuacguguuuacccaccuucauguccaggaguucuuugcagccauguucuauaugcugaagggcucuugggaggcugggaaccccagcugucaaccuuucgaagacuugaaaucacuccugcagaguacguccuacaaggauccacacuuaacccagaugaaaugcuuucuguucggacuacucaacgaggacagagugaagcagcuggaaaggacauuuaauugcaaaaugagccuuaagaucaagucuaaauugcugcaauguauggagguucucgguaacucagacuacagucccagccagcugggcuucuuagaacuguuucauugccuuuaugagacucaggauaaggcguucaucucccaggcaaugcgguguuuuccgaaaguggccauuaauauaugcgagaagauccacuugcucgucucuucguucugucugaaacacugccgaugucuacgcaccauuagacugagcgugacaguaguuuuugaaaagaaaauccucaagacuucccugccuaccaacacaugggacggggauaggauaacccauugcuggcaagaccuuuguucaguguugcacacuaaugagcaucugcgggaauuagaucucuaccacaguaaccuggacaagucugcuaugaauauucuucaucacgagcugcgccaccccaacugcaaauugcagaagcuccugcuaaaauucaucacguuuccagauggaugucaggacaucagcacaucccugauucauaauaagaaccucaugcaccuggaucuuaaaggcucagacaucggugauaauggggucaagagcuugugcgaagcccugaagcauccugagugcaaauuacaaacccucagacuggagucuuguaaccuuacuguguucugcugucugaauauuuccaacgcacuaauaaggagucagagccucaucuuucugaauuugucuaccaacaaccuguuagacgauggcguccagcuccugugcgaagcccuucgucaccccaaguguuaucuggagcgguugucccucgaaucaugcggacugacagaggcuggcugugaguaccuaagucuggcccuuauuagcaauaaacgacucacccaccugugcuuggcagacaacgugcugggggacggagguguuaaguuaaugucggaugcgcuccagcaugcucaauguacucugaaaucccuugugcugagaaggugccacuucacaucuuugagcucagaauaucucaguacgucccugcuacauaauaagucucugacccaccuugaccucggcagcaacuggcugcaggauaaugggguaaaguuguuaugugacgucuuccgccauccauccugcaaccugcaggaucucgagcugaugggaugcgugcuuacuaaugccuguugccuggacuuggcaucaguuauccuaaacaaucccaaccugcggagccucgaucugggcaauaacgaccuucaggaugacggugugaaaaucuuaugugaugcccugagauacccuaauugcaacauucaaaggcucggguuggaauauuguggccugacaagucucugcugucaggaccugucuuccgcucuuauaugcaauaagcgccugaucaaaaugaacuugacccagaacacacuaggauacgagggcauugucaagcuguacaaagugcucaagagcccaaaguguaaauuacagguacuggggcuuugcaaggaagccuuugaugaggaggcacaaaaacugcucgaagcugugggaguuucgaauccgcacuugaucauuaagcccgacuguaacuaucacaaugaggaagacgucucauggugguggugcuucuga

SEQ ID NO: 9142 - RNA, 3282 nt, Artificial Sequence
  derived and/or modified sequence opt4 from NLRP14__Homo_sapiens__AAO18165
auggccgacagcagcagcagcagcuucuuccccgacuucggccugcugcuguaccuggaggagcugaacaaggaggagcugaacaccuucaagcuguuccugaaggagaccauggagcccgagcacggccugacccccuggaacgaggugaagaaggccagaagagaggaccuggccaaccugaugaagaaguacuaccccggcgagaaggccuggagcgugagccugaagaucuucggcaagaugaaccugaaggaccugugcgagagagccaaggaggagaucaacuggagcgcccagaccaucggccccgacgacgccaaggccggcgagacccaggaggaccaggaggccgugcugggcgacggcaccgaguacagaaacagaaucaaggagaaguucugcaucaccugggacaagaagagccuggccggcaagcccgaggacuuccaccacggcaucgccgagaaggacagaaagcugcuggagcaccuguucgacguggacgugaagaccggcgcccagccccagaucguggugcugcagggcgccgccggcgugggcaagaccacccuggugagaaaggccaugcuggacugggccgagggcagccuguaccagcagagauucaaguacguguucuaccugaacggcagagagaucaaccagcugaaggagagaagcuucgcccagcugaucagcaaggacuggcccagcaccgagggccccaucgaggagaucauguaccagcccagcagccugcuguucaucaucgacagcuucgacgagcugaacuucgccuucgaggagcccgaguucgcccugugcgaggacuggacccaggagcaccccgugagcuuccugaugagcagccugcugagaaaggugaugcugcccgaggccagccugcuggugaccaccagacugaccaccagcaagagacugaagcagcugcugaagaaccaccacuacguggagcugcugggcaugagcgaggacgccagagaggaguacaucuaccaguucuucgaggacaagagaugggccaugaagguguucagcagccugaagagcaacgagaugcuguucagcaugugccaggugccccuggugugcugggccgccugcaccugccugaagcagcagauggagaagggcggcgacgugacccugaccugccagaccaccaccgcccuguucaccugcuacaucagcagccuguucacccccguggacggcggcagccccagccugcccaaccaggcccagcugagaagacugugccagguggccgccaagggcaucuggaccaugaccuacguguucuacagagagaaccugagaagacugggccugacccagagcgacgugagcagcuucauggacagcaacaucauccagaaggacgccgaguacgagaacugcuacguguucacccaccugcacgugcaggaguucuucgccgccauguucuacaugcugaagggcagcugggaggccggcaaccccagcugccagcccuucgaggaccugaagagccugcugcagagcaccagcuacaaggacccccaccugacccagaugaagugcuuccuguucggccugcugaacgaggacagagugaagcagcuggagagaaccuucaacugcaagaugagccugaagaucaagagcaagcugcugcagugcauggaggugcugggcaacagcgacuacagccccagccagcugggcuuccuggagcuguuccacugccuguacgagacccaggacaaggccuucaucagccaggccaugagaugcuuccccaagguggccaucaacaucugcgagaagauccaccugcuggugagcagcuucugccugaagcacugcagaugccugagaaccaucagacugagcgugaccgugguguucgagaagaagauccugaagaccagccugcccaccaacaccugggacggcgacagaaucacccacugcuggcaggaccugugcagcgugcugcacaccaacgagcaccugagagagcuggaccuguaccacagcaaccuggacaagagcgccaugaacauccugcaccacgagcugagacaccccaacugcaagcugcagaagcugcugcugaaguucaucaccuuccccgacggcugccaggacaucagcaccagccugauccacaacaagaaccugaugcaccuggaccugaagggcagcgacaucggcgacaacggcgugaagagccugugcgaggcccugaagcaccccgagugcaagcugcagacccugagacuggagagcugcaaccugaccguguucugcugccugaacaucagcaacgcccugaucagaagccagagccugaucuuccugaaccugagcaccaacaaccugcuggacgacggcgugcagcugcugugcgaggcccugagacaccccaagugcuaccuggagagacugagccuggagagcugcggccugaccgaggccggcugcgaguaccugagccuggcccugaucagcaacaagagacugacccaccugugccuggccgacaacgugcugggcgacggcggcgugaagcugaugagcgacgcccugcagcacgcccagugcacccugaagagccuggugcugagaagaugccacuucaccagccugagcagcgaguaccugagcaccagccugcugcacaacaagagccugacccaccuggaccugggcagcaacuggcugcaggacaacggcgugaagcugcugugcgacguguucagacaccccagcugcaaccugcaggaccuggagcugaugggcugcgugcugaccaacgccugcugccuggaccuggccagcgugauccugaacaaccccaaccugagaagccuggaccugggcaacaacgaccugcaggacgacggcgugaagauccugugcgacgcccugagauaccccaacugcaacauccagagacugggccuggaguacugcggccugaccagccugugcugccaggaccugagcagcgcccugaucugcaacaagagacugaucaagaugaaccugacccagaacacccugggcuacgagggcaucgugaagcuguacaaggugcugaagagccccaagugcaagcugcaggugcugggccugugcaaggaggccuucgacgaggaggcccagaagcugcuggaggccgugggcgugagcaacccccaccugaucaucaagcccgacugcaacuaccacaacgaggaggacgugagcuggugguggugcuucuga

SEQ ID NO: 9143 - RNA, 3282 nt, Artificial Sequence
  derived and/or modified sequence opt5 from NLRP14__Homo_sapiens__AAO18165
auggccgacagcuccucuagcuccuucuuucccgauuucggccugcuccuguaccuugaggaacugaacaaggaggaacucaauaccuuuaaacuguuccuuaaggagacaauggaaccugagcacgggcugacgccguggaacgaggugaaaaaggcuagacgggaagaccucgccaaucugaugaaaaaguauuaccccggagagaaggcguggucugucagccugaaaaucuuuggcaagaugaaccucaaagaucugugcgaacgcgcuaaggaggagauuaauugguccgcccagaccaucgggccugacgaugccaaagcuggagaaacacaagaggaccaggaagccguucuuggcgaugggaccgaguauagaaaccggauuaaggaaaaguucuguaucacaugggacaaaaagucucuggcuggaaaacccgaggauuuucaucacggcauugccgagaaggaccgcaaacuccuggaacaucuuuucgauguggacgugaagaccggcgcgcagccucagaucgucgugcugcaaggggccgcuggaguuggcaaaacaacccucgugagaaaggccaugcuggauugggcugaggggagccuguaccagcagcgguuuaaguaugucuucuaccucaauggacgcgaaaucaaccagcugaaagagagauccuuugcccaacuuauuagcaaggacuggcccucuacggaaggcccuaucgaggagauuauguaucagccguccagccugcuguucaucauugacucuuuugaugaacugaauuucgcguucgaggaacccgaguuugcccuuugcgaagacuggacccaggagcacccuguguccuuccugaugagcucucuccugcggaaaguuaugcugcccgaggcuucccuccuggugacaacccgccuuacaaccagcaagagacugaaacagcuccugaagaaccaucacuacgucgaacuucuggggauguccgaggaugcccgggaagaguacaucuaucaauuuuucgaggacaagcgcugggcuaugaaaguguuuucuagccucaaguccaaugaaaugcuguucagcaugugucaggugccucuggucugcugggccgccuguacgugccucaaacagcaaauggagaagggaggcgauguuacacugaccugucagacaaccaccgcucuuuuuacaugcuacauuucuucccuguucacgcccguggacggcgggagcccgucucucccuaaccaggcgcagcugagacggcugugucaaguggccgcuaaaggaaucuggaccaugacauaugucuuuuaccgcgaaaaucuuagacggcucggccugacccagagcgauguguccucuuucauggacagcaacaucauucagaaggaugccgaguaugaaaauugcuacguuuuuacacaccuccaugugcaggaguucuuugccgcuauguucuauaugcucaagggguccugggaggccggaaaccccagcugucaaccuuucgaagaccugaaaucucuucugcaguccaccagcuacaaggauccccaccucacgcagaugaaaugcuuucuguucggccugcuuaacgaggacagagucaagcagcucgaacgcacauuuaauugcaaaaugucucugaagaucaaguccaaacugcuccaauguauggaggugcuggggaacagcgacuacucccccucucagcuuggauuccuggaacucuuucauugccuguaugagacccaggauaaggcguucauuagccaggcuaugcgguguuuuccuaaaguugccaucaauauuugcgagaagauccaccuucuuguguccucuuucugucucaaacacugcagaugucugcgcaccauccggcugagcgucacaguggucuuugaaaagaaaauucucaagaccucccugccgacaaacacgugggacggcgauagaaucacccauugcuggcaagaccuuuguagcgugcugcacacaaaugagcaucuccgcgaacuggaucuguaccacucuaaccuugacaaguccgccaugaauauucuccaucacgagcugcggcaccccaacugcaaacugcagaagcuccugcuuaaauucaucaccuuuccugauggcugucaggacauuagcacaucucugauccauaauaagaaccucaugcaccuggaucugaaaggguccgacaucggagauaauggcguuaagagccuuugcgaagcucugaagcaucccgagugcaaacuccaaacccugagacucgagucuuguaaccugacgguguucugcugucuuaauauuagcaacgcccugauccgcucccagagccucauuuuucugaaucugucuaccaacaaccuucuggacgaugggguccagcuccugugcgaagcucuccggcacccuaaguguuaucuggagagacuuucccuggaaagcugcggacucacagaggccggcugugaguaccugucccuggcgcuuaucucuaauaaacgccugacccaccucugccuggccgacaacgugcucggggacggcggaguuaagcugaugagcgaugcucugcagcaugcccaauguacacugaaaucccuggugcuccggagaugccacuucaccucucugagcuccgaauaucuuucuacgagccugcuccauaauaagucccugacacaccucgaccugggcagcaacuggcuucaggauaauggggucaagcugcugugugacguguuccggcaucccucuugcaaccuccaggaucuggagcuuaugggaugcgugcugaccaaugcuuguugccucgaccuggccuccguuauucucaacaauccgaaccugcgcagccuugaucugggcaauaacgaccugcaggaugacggggucaaaauccucugugaugcgcugagauacccuaauugcaacauucaacggcuuggacuggaauauuguggccucacaucucugugcugucaggaccucuccagcgcccugaucugcaauaagagacuuaucaaaaugaaccugacccagaacacccugggguacgagggcauugugaagcucuacaaagugcugaagucucccaaguguaaacuucagguccugggacucugcaaggaggcuuuugaugaagaggcccaaaaacugcuggaagcugugggcguuuccaauccucaccucaucauuaagcccgacuguaacuaucacaaugaggaagacgugagcuggugguggugcuucuga

SEQ ID NO: 9144 - protein, 779 aa, Artificial Sequence
  NOD1__Homo_sapiens__G3XAL1
MEEQGHSEMEIIPSESHPHIQLLKSNRELLVTHIRNTQCLVDNLLKNDYFSAEDAEIVCACPTQPDKVRKILDLVQSKGEEVSEFFLYLLQQLADAYVDLRPWLLEIGFSPSLLTQSKVVVNTDPVSRYTQQLRHHLGRDSKFVLCYAQKEELLLEEIYMDTIMELVGFSNESLGSLNSLACLLDHTTGILNEQGETIFILGDAGVGKSMLLQRLQSLWATGRLDAGVKFFFHFRCRMFSCFKESDRLCLQDLLFKHYCYPERDPEEVFAFLLRFPHVALFTFDGLDELHSDLDLSRVPDSSCPWEPAHPLVLLANLLSGKLLKGASKLLTARTGIEVPRQFLRKKVLLRGFSPSHLRAYARRMFPERALQDRLLSQLEANPNLCSLCSVPLFCWIIFRCFQHFRAAFEGSPQLPDCTMTLTDVFLLVTEVHLNRMQPSSLVQRNTRSPVETLHAGRDTLCSLGQVAHRGMEKSLFVFTQEEVQASGLQERDMQLGFLRALPELGPGGDQQSYEFFHLTLQAFFTAFFLVLDDRVGTQELLRFFQEWMPPAGAATTSCYPPFLPFQCLQGSGPAREDLFKNKDHFQFTNLFLCGLLSKAKQKLLRHLVPAAALRRKRKALWAHLFSSLRGYLKSLPRVQVESFNQVQAMPTFIWMLRCIYETQSQKVGQLAARGICANYLKLTYCNACSADCSALSFVLHHFPKRLALDLDNNNLNDYGVRELQPCFSRLTVLRLSVNQITDGGVKVLSEELTKYKIVTYLGLWKSVDTICFKKQGLLK

SEQ ID NO: 9145 - RNA, 2340 nt, Artificial Sequence
  NOD1__Homo_sapiens__EAW93948
auggaagagcagggccacagugagauggaaauaaucccaucagagucucacccccacauucaauuacugaaaagcaaucgggaacuucuggucacucacauccgcaauacucagugucugguggacaacuugcugaagaaugacuacuucucggccgaagaugcggagauugugugugccugccccacccagccugacaagguccgcaaaauucuggaccugguacagagcaagggcgaggagguguccgaguucuuccucuacuugcuccagcaacucgcagaugccuacguggaccucaggccuuggcugcuggagaucggcuucuccccuucccugcucacucagagcaaagucguggucaacacugacccagugagcagguauacccagcagcugcgacaccaucugggccgugacuccaaguucgugcugugcuaugcccagaaggaggagcugcugcuggaggagaucuacauggacaccaucauggagcugguuggcuucagcaaugagagccugggcagccugaacagccuggccugccuccuggaccacaccaccggcauccucaaugagcagggugagaccaucuucauccugggugaugcuggggugggcaaguccaugcugcuacagcggcugcagagccucugggccacgggccggcuagacgcaggggucaaauucuucuuccacuuucgcugccgcauguucagcugcuucaaggaaagugacaggcugugucugcaggaccugcucuucaagcacuacugcuacccagagcgggaccccgaggagguguuugccuuccugcugcgcuucccccacguggcccucuucaccuucgauggccuggacgagcugcacucggacuuggaccugagccgcgugccugacagcuccugccccugggagccugcccacccccuggucuugcuggccaaccugcucagugggaagcugcucaagggggcuagcaagcugcucacagcccgcacaggcaucgaggucccgcgccaguuccugcggaagaaggugcuucuccggggcuucucccccagccaccugcgcgccuaugccaggaggauguuccccgagcgggcccugcaggaccgccugcugagccagcuggaggccaaccccaaccucugcagccugugcucugugccccucuucugcuggaucaucuuccggugcuuccagcacuuccgugcugccuuugaaggcucaccacagcugcccgacugcacgaugacccugacagaugucuuccuccuggucacugagguccaucugaacaggaugcagcccagcagccuggugcagcggaacacacgcagcccaguggagacccuccacgccggccgggacacucugugcucgcuggggcagguggcccaccggggcauggagaagagccucuuugucuucacccaggaggaggugcaggccuccgggcugcaggagagagacaugcagcugggcuuccugcgggcuuugccggagcugggccccgggggugaccagcaguccuaugaguuuuuccaccucacccuccaggccuucuuuacagccuucuuccucgugcuggacgacagggugggcacucaggagcugcucagguucuuccaggaguggaugcccccugcgggggcagcgaccacguccugcuauccucccuuccucccguuccagugccugcagggcagugguccggcgcgggaagaccucuucaagaacaaggaucacuuccaguucaccaaccucuuccugugcgggcuguuguccaaagccaaacagaaacuccugcggcaucuggugcccgcggcagcccugaggagaaagcgcaaggcccugugggcacaccuguuuuccagccugcggggcuaccugaagagccugccccgcguucaggucgaaagcuucaaccaggugcaggccaugcccacguucaucuggaugcugcgcugcaucuacgagacacagagccagaagguggggcagcuggcggccaggggcaucugcgccaacuaccucaagcugaccuacugcaacgccugcucggccgacugcagcgcccucuccuucguccugcaucacuuccccaagcggcuggcccuagaccuagacaacaacaaucucaacgacuacggcgugcgggagcugcagcccugcuucagccgccucacuguucucagacucagcguaaaccagaucacugacggugggguaaaggugcuaagcgaagagcugaccaaauacaaaauugugaccuauuugggacuuuggaaaucaguagacaccauaugcuucaaaaaacaggggcuauuaaaauga

SEQ ID NO: 9146 - RNA, 2340 nt, Artificial Sequence
  derived and/or modified sequence opt1 from NOD1__Homo_sapiens__EAW93948
auggaggagcagggccacagcgagauggagaucauccccuccgagagccacccgcacauccagcugcucaaguccaaccgcgagcugcuggugacccacauccggaacacccagugccucgucgacaaccugcugaagaacgacuacuucagcgccgaggacgccgagaucgugugcgcgugccccacgcagcccgacaaggugcgcaagauccucgaccugguccaguccaagggggaggaggugagcgaguucuuccuguaccuccugcagcagcuggccgacgccuacguggaccuccggcccuggcugcuggagaucggcuucuccccgagccuccugacccaguccaaggucguggugaacaccgaccccgucagccgcuacacccagcagcugcggcaccaccucgggcgcgacuccaaguucgugcugugcuacgcccagaaggaggagcugcuccuggaggagaucuacauggacacgaucauggagcuggugggcuucagcaacgagucccucgggagccugaacucccuggccugccuccuggaccacaccaccggcauccugaacgagcagggcgagaccaucuucauccucggggacgcgggcgucggcaagagcaugcugcugcagcggcuccagucccugugggccacggggcgccuggacgccggggugaaguucuucuuccacuuccggugccgcauguucagcugcuucaaggaguccgaccggcucugccugcaggaccugcuguucaagcacuacugcuaccccgagcgcgaccccgaggagguguucgccuuccugcugcgguucccgcacgucgcgcuguucaccuucgacggccuggacgagcugcacagcgaccucgaccugagccgcgugcccgacuccagcugccccugggagcccgcccacccgcuggugcuccuggccaaccugcuguccggcaagcuccugaagggggccagcaagcugcucaccgcccggaccggcaucgaggucccccgccaguuccugcggaagaaggugcugcuccgcggguucucccccagccaccuccgggcguacgcccgccggauguuccccgagcgcgcccugcaggaccgccuccugucccagcuggaggccaacccgaaccucugcagccugugcuccgugccccuguucugcuggaucaucuuccggugcuuccagcacuuccgcgccgcguucgagggcagcccccagcuccccgacugcacgaugacccugaccgacgucuuccugcucgugaccgaggugcaccugaaccggaugcagccguccagccugguccagcgcaacacgcggucccccguggagacccuccacgccggccgcgacacccugugcagccuggggcaggucgcccaccggggcauggagaagucccucuucguguucacccaggaggaggugcaggccagcgggcugcaggagcgcgacaugcagcugggcuuccuccgggcccugcccgagcuggggcccggcggcgaccagcaguccuacgaguucuuccaccucacgcugcaggcguucuucaccgccuucuuccugguccucgacgaccgcguggggacccaggagcugcugcgguucuuccaggaguggaugccgcccgccggcgccgccaccacgagcugcuacccgcccuuccuccccuuccagugccugcagggguccggccccgcgcgcgaggaccuguucaagaacaaggaccacuuccaguucaccaaccucuuccugugcgggcugcucagcaaggccaagcagaagcugcugcggcaccucgugcccgccgccgcgcugcgccggaagcgcaaggcccugugggcccaccucuucagcucccugcggggcuaccucaagagccucccgcgcguccagguggaguccuucaaccaggugcaggccaugcccaccuucaucuggaugcugcggugcaucuacgagacccagagccagaaggucggccagcuggccgcgcgcgggaucugcgccaacuaccucaagcugacguacugcaacgccugcuccgccgacugcagcgcccuguccuucgugcuccaccacuuccccaagcgccuggcgcuggaccucgacaacaacaaccugaacgacuacggcgugcgggagcugcagcccugcuucagccgccucaccguccugcggcuguccgugaaccagaucaccgacgggggcgugaagguccucagcgaggagcugaccaaguacaagaucgugacguaccuggggcucuggaaguccguggacaccaucugcuucaagaagcagggccugcugaaguga

SEQ ID NO: 9147 - RNA, 2340 nt, Artificial Sequence
  derived and/or modified sequence opt2 from NOD1__Homo_sapiens__EAW93948
auggaggagcagggccacuccgagauggagaucauccccuccgagucccacccccacauccagcuccucaaguccaaccgcgagcuccucgucacccacauccgcaacacccagugccucgucgacaaccuccucaagaacgacuacuucuccgccgaggacgccgagaucgucugcgccugccccacccagcccgacaagguccgcaagauccucgaccucguccaguccaagggcgaggaggucuccgaguucuuccucuaccuccuccagcagcucgccgacgccuacgucgaccuccgccccuggcuccucgagaucggcuucucccccucccuccucacccaguccaaggucgucgucaacaccgaccccgucucccgcuacacccagcagcuccgccaccaccucggccgcgacuccaaguucguccucugcuacgcccagaaggaggagcuccuccucgaggagaucuacauggacaccaucauggagcucgucggcuucuccaacgagucccucggcucccucaacucccucgccugccuccucgaccacaccaccggcauccucaacgagcagggcgagaccaucuucauccucggcgacgccggcgucggcaaguccaugcuccuccagcgccuccagucccucugggccaccggccgccucgacgccggcgucaaguucuucuuccacuuccgcugccgcauguucuccugcuucaaggaguccgaccgccucugccuccaggaccuccucuucaagcacuacugcuaccccgagcgcgaccccgaggaggucuucgccuuccuccuccgcuucccccacgucgcccucuucaccuucgacggccucgacgagcuccacuccgaccucgaccucucccgcguccccgacuccuccugccccugggagcccgcccacccccucguccuccucgccaaccuccucuccggcaagcuccucaagggcgccuccaagcuccucaccgcccgcaccggcaucgaggucccccgccaguuccuccgcaagaagguccuccuccgcggcuucucccccucccaccuccgcgccuacgcccgccgcauguuccccgagcgcgcccuccaggaccgccuccucucccagcucgaggccaaccccaaccucugcucccucugcuccgucccccucuucugcuggaucaucuuccgcugcuuccagcacuuccgcgccgccuucgagggcuccccccagcuccccgacugcaccaugacccucaccgacgucuuccuccucgucaccgagguccaccucaaccgcaugcagcccuccucccucguccagcgcaacacccgcucccccgucgagacccuccacgccggccgcgacacccucugcucccucggccaggucgcccaccgcggcauggagaagucccucuucgucuucacccaggaggagguccaggccuccggccuccaggagcgcgacaugcagcucggcuuccuccgcgcccuccccgagcucggccccggcggcgaccagcaguccuacgaguucuuccaccucacccuccaggccuucuucaccgccuucuuccucguccucgacgaccgcgucggcacccaggagcuccuccgcuucuuccaggaguggaugccccccgccggcgccgccaccaccuccugcuacccccccuuccuccccuuccagugccuccagggcuccggccccgcccgcgaggaccucuucaagaacaaggaccacuuccaguucaccaaccucuuccucugcggccuccucuccaaggccaagcagaagcuccuccgccaccucguccccgccgccgcccuccgccgcaagcgcaaggcccucugggcccaccucuucuccucccuccgcggcuaccucaagucccucccccgcguccaggucgaguccuucaaccagguccaggccaugcccaccuucaucuggaugcuccgcugcaucuacgagacccagucccagaaggucggccagcucgccgcccgcggcaucugcgccaacuaccucaagcucaccuacugcaacgccugcuccgccgacugcuccgcccucuccuucguccuccaccacuuccccaagcgccucgcccucgaccucgacaacaacaaccucaacgacuacggcguccgcgagcuccagcccugcuucucccgccucaccguccuccgccucuccgucaaccagaucaccgacggcggcgucaagguccucuccgaggagcucaccaaguacaagaucgucaccuaccucggccucuggaaguccgucgacaccaucugcuucaagaagcagggccuccucaaguga

SEQ ID NO: 9148 - RNA, 2340 nt, Artificial Sequence
  derived and/or modified sequence opt3 from NOD1__Homo_sapiens__EAW93948
auggaggaacagggccacagcgagauggaaaucauucccuccgagucucauccucacauacaacugcucaagucaaacagagaacuucuggugacccauaucaggaauacacagugcuuggucgacaacuuacugaaaaaugauuacuucagugccgaggacgcugagauuguuugugcaugcccaacucagccggauaaggugcggaaaauccuagaccucguacagagcaagggggaagagguguccgaauuuuuccuguaucuucugcaacaguuggccgaugcguacgucgaccuccgccccuggcugcuggagauuggauuuucuccuucgcucuuaacgcagucaaaagugguugugaacaccgauccagucagccgauauacacagcaacugcgucaccaucuugguagagacaguaaguucguguuguguuacgcucagaaggaggaacugcuacucgaggaaaucuauauggauacuauaauggagcugguaggcuuuuccaaugaaucucuugggagccugaacuccuuggccugccuccuggaccacaccacaggaaucuuaaaugagcagggcgagaccauuuucauccugggugaugcagggguuggaaaaucaaugcuccuucagaggcugcaaaguuugugggccacuggccggcuagacgcuggcgugaaguuuuucuuucacuuccgcuguagaauguuuagcugcuucaaagaaucugauaggcugugucuccaggaccugcuuuuuaagcauuacugcuaucccgagcgggacccugaagaggucuucgcauuccuguugcgcuuuccacacguggcccucuucacauuugaugggcuggacgaauuacauuccgaucuggaccuaucacgagugcccgauagcaguuguccuugggagccagcucacccgcucguccugcuugccaacuugcugucuggaaaacuccugaagggugcguccaaacuucugaccgcaagaacgggcauugagguucccaggcaguucuugcggaagaaggugcuccugcguggguuuagcccuucgcacuuacgcgccuacgcuagaaggauguucccagaacgggcccugcaagaccgacuacucucucagcuggaggcaaaucccaaccuuugcuccuuguguucaguaccucuguuuugcuggaucauauuccgcugcuuucagcauuucagagcugccuuugaaggaaguccacagcuccccgauuguacuaugacccugacagacguguucuuacuggucacugaggugcaccuuaauaggaugcaaccgagcuccuugguucagcggaacacccgcucuccuguggaaacacuccaugcgggcagagauacccugugcagccuaggucaggucgcccacagggggauggagaaaucacuguuuguguucacgcaggaggaaguacaagcaaguggacuccaggagcgugacaugcagcugggcuuccuucgggcuuugcccgaacugggcccagggggagaucagcaauccuacgaguuuuuccauuuaacucuccaggccuuuuucacagccuuuuuccugguucuugacgaccgaguggguacccaggagcuguugagauuuuuccaggaauggaugccucccgcuggcgcagccacuacaagcuguuauccacccuuucucccuuuccaaugccugcaggggucuggaccagcuagggaggaucuauuuaagaauaaagaccacuuccaguuuaccaaccuguuccucuguggccugcuuucaaaggcgaaacaaaaguugcugcgccacuuagucccggcagccgcucuccggagaaagaggaaagcccugugggcacaucuuuucaguagccugcgcgguuaccuaaagucccucccccgagugcaggucgaaucuuuuaaucaggugcaggccaugccuacguucauuuggaugcugcggugcaucuaugagacccaaucgcagaaaguugggcaguuggcugcccguggcauuugugcaaacuaccugaaguuaacauauugcaacgcguguagcgcugauugcuccgcccucucauuugugcugcaccauuucccaaaaagacuugcacuggacuuggauaauaacaaucucaacgacuacggaguaagggaacugcagcccuguuuuagucgccuaacuguccugcggcuuucugugaaucaaaucaccgauggcgggguuaaggugcucagcgaggagcugacaaaguauaaaaucgucacuuacuugggacuguggaaguccguggacaccauuugcuucaaaaagcaggguuuacucaaauga

SEQ ID NO: 9149 - RNA, 2340 nt, Artificial Sequence
  derived and/or modified sequence opt4 from NOD1__Homo_sapiens__EAW93948
auggaggagcagggccacagcgagauggagaucauccccagcgagagccacccccacauccagcugcugaagagcaacagagagcugcuggugacccacaucagaaacacccagugccugguggacaaccugcugaagaacgacuacuucagcgccgaggacgccgagaucgugugcgccugccccacccagcccgacaaggugagaaagauccuggaccuggugcagagcaagggcgaggaggugagcgaguucuuccuguaccugcugcagcagcuggccgacgccuacguggaccugagacccuggcugcuggagaucggcuucagccccagccugcugacccagagcaaggugguggugaacaccgaccccgugagcagauacacccagcagcugagacaccaccugggcagagacagcaaguucgugcugugcuacgcccagaaggaggagcugcugcuggaggagaucuacauggacaccaucauggagcuggugggcuucagcaacgagagccugggcagccugaacagccuggccugccugcuggaccacaccaccggcauccugaacgagcagggcgagaccaucuucauccugggcgacgccggcgugggcaagagcaugcugcugcagagacugcagagccugugggccaccggcagacuggacgccggcgugaaguucuucuuccacuucagaugcagaauguucagcugcuucaaggagagcgacagacugugccugcaggaccugcuguucaagcacuacugcuaccccgagagagaccccgaggagguguucgccuuccugcugagauucccccacguggcccuguucaccuucgacggccuggacgagcugcacagcgaccuggaccugagcagagugcccgacagcagcugccccugggagcccgcccacccccuggugcugcuggccaaccugcugagcggcaagcugcugaagggcgccagcaagcugcugaccgccagaaccggcaucgaggugcccagacaguuccugagaaagaaggugcugcugagaggcuucagccccagccaccugagagccuacgccagaagaauguuccccgagagagcccugcaggacagacugcugagccagcuggaggccaaccccaaccugugcagccugugcagcgugccccuguucugcuggaucaucuucagaugcuuccagcacuucagagccgccuucgagggcagcccccagcugcccgacugcaccaugacccugaccgacguguuccugcuggugaccgaggugcaccugaacagaaugcagcccagcagccuggugcagagaaacaccagaagccccguggagacccugcacgccggcagagacacccugugcagccugggccagguggcccacagaggcauggagaagagccuguucguguucacccaggaggaggugcaggccagcggccugcaggagagagacaugcagcugggcuuccugagagcccugcccgagcugggccccggcggcgaccagcagagcuacgaguucuuccaccugacccugcaggccuucuucaccgccuucuuccuggugcuggacgacagagugggcacccaggagcugcugagauucuuccaggaguggaugccccccgccggcgccgccaccaccagcugcuacccccccuuccugcccuuccagugccugcagggcagcggccccgccagagaggaccuguucaagaacaaggaccacuuccaguucaccaaccuguuccugugcggccugcugagcaaggccaagcagaagcugcugagacaccuggugcccgccgccgcccugagaagaaagagaaaggcccugugggcccaccuguucagcagccugagaggcuaccugaagagccugcccagagugcagguggagagcuucaaccaggugcaggccaugcccaccuucaucuggaugcugagaugcaucuacgagacccagagccagaaggugggccagcuggccgccagaggcaucugcgccaacuaccugaagcugaccuacugcaacgccugcagcgccgacugcagcgcccugagcuucgugcugcaccacuuccccaagagacuggcccuggaccuggacaacaacaaccugaacgacuacggcgugagagagcugcagcccugcuucagcagacugaccgugcugagacugagcgugaaccagaucaccgacggcggcgugaaggugcugagcgaggagcugaccaaguacaagaucgugaccuaccugggccuguggaagagcguggacaccaucugcuucaagaagcagggccugcugaaguga

SEQ ID NO: 9150 - RNA, 2340 nt, Artificial Sequence
  derived and/or modified sequence opt5 from NOD1__Homo_sapiens__EAW93948
auggaggaacagggccacagcgagauggaaaucauucccuccgagucucauccucacauccaacugcucaagagcaacagagaacugcuugugacccauauucggaauacacagugccuggucgacaaccuccugaaaaaugauuacuucuccgccgaggacgcugagaucguuugugccugcccgacgcagcccgauaaggugcgcaaaauucuugaccuggugcagucuaagggggaagaggucagcgaauuuuuccucuaucugcugcaacagcucgcggaugcuuacguggaccugagaccuuggcuucuggagaucggauuuucccccucucuccugacccagagcaaaguuguggucaacacagauccugugucccgguauacccagcaacuucgccaccaucugggcagagacagcaaguucguucucuguuacgcccagaaggaggaacugcugcucgaggaaaucuauauggauacaauuauggagcuggugggguuuucuaaugaaucccuuggaagccugaacucucucgccugccugcuugaccacaccacaggcauccugaaugagcagggggagaccauuuucauccucggagaugcuggcgucggcaaauccaugcugcugcagcggcuccaaagccugugggccacggggcgccuugacgcuggagugaaguuuuucuuucacuucagaugucggauguuuucuugcuucaaagaauccgaucgccugugucuccaggaccugcuuuuuaagcauuacugcuaucccgagagagacccugaagagguguucgccuuccugcuccgguuuccgcacgucgcgcuguucaccuuugauggccuggacgaacuccauagcgaucuggaccuuucccgcguucccgauucuagcuguccuugggagcccgcccacccucuggugcuccuggcuaaccugcuuuccgggaaacuccugaagggagccagcaagcugcucacagcuagaaccggcauugaggugccccggcaguuccugcgcaaaaagguccuucugagaggguuuucuccgucccaccuccgggccuacgcgagacgcauguucccugaacgggcccugcaagacagacugcuuagccagcucgaggcuaaucccaaccugugcucucuguguagcgugccucucuuuugcuggaucauuuuccgcugcuuucagcauuuccgggccgcuuuugaaggaucuccccagcugcccgauuguacaaugacccuuacggacguuuuccugcucgugacagagguccaccugaauagaaugcaaccuuccagccuggugcagcgcaacacccgguccccgguugaaacacuucaugccggcagagauacccucugcagccugggccagguggcccaccgcgggauggagaaaucucuguuugucuucacccaggaggaagugcaggcuuccggacuccaagagcgggacaugcagcugggcuuccuuagagcgcugcccgaacucgggccuggaggcgaucagcaaagcuacgaguuuuuccaucugacacugcaggccuuuuucacggccuuuuuccuuguccucgacgaccgcguggggacccaggagcugcugcgguuuuuccaggaauggaugcccccugcuggagccgcuacaaccucuuguuaucccccguuucucccuuuccaaugccugcagggcuccggccccgccagagaggaucuuuuuaagaauaaagaccacuuccaguuuacaaaccuguuccucugugggcugcugagcaaggcgaaacaaaagcugcugcggcaccucguuccugcugccgcccugcgcagaaagcggaaagcucucugggcccaucuguucuccucucuuagaggauaccuuaagagccucccccgcgugcaggucgaauccuuuaaucaggugcaggcuaugccuaccuucaucuggaugcugcggugcaucuaugagacgcaaucucagaaaguuggccagcuggccgcgagagggauuugugccaacuaccuuaagcugacauauugcaacgcuuguagcgccgauugcuccgcucucagcuuugugcugcaccauuuccccaaacgccucgcccuggaccuugauaauaacaaucugaacgacuacggagucagagaacuccagccguguuuuucucggcugaccgugcugcgccuuuccgugaaucaaaucaccgauggcgggguuaagguccugagcgaggagcucacaaaguauaaaauugugaccuaccugggccucuggaagucuguggacacaaucugcuucaaaaagcagggacugcuuaaauga

SEQ ID NO: 9151 - protein, 953 aa, Artificial Sequence
  NOD1__Homo_sapiens__Q9Y239
MEEQGHSEMEIIPSESHPHIQLLKSNRELLVTHIRNTQCLVDNLLKNDYFSAEDAEIVCACPTQPDKVRKILDLVQSKGEEVSEFFLYLLQQLADAYVDLRPWLLEIGFSPSLLTQSKVVVNTDPVSRYTQQLRHHLGRDSKFVLCYAQKEELLLEEIYMDTIMELVGFSNESLGSLNSLACLLDHTTGILNEQGETIFILGDAGVGKSMLLQRLQSLWATGRLDAGVKFFFHFRCRMFSCFKESDRLCLQDLLFKHYCYPERDPEEVFAFLLRFPHVALFTFDGLDELHSDLDLSRVPDSSCPWEPAHPLVLLANLLSGKLLKGASKLLTARTGIEVPRQFLRKKVLLRGFSPSHLRAYARRMFPERALQDRLLSQLEANPNLCSLCSVPLFCWIIFRCFQHFRAAFEGSPQLPDCTMTLTDVFLLVTEVHLNRMQPSSLVQRNTRSPVETLHAGRDTLCSLGQVAHRGMEKSLFVFTQEEVQASGLQERDMQLGFLRALPELGPGGDQQSYEFFHLTLQAFFTAFFLVLDDRVGTQELLRFFQEWMPPAGAATTSCYPPFLPFQCLQGSGPAREDLFKNKDHFQFTNLFLCGLLSKAKQKLLRHLVPAAALRRKRKALWAHLFSSLRGYLKSLPRVQVESFNQVQAMPTFIWMLRCIYETQSQKVGQLAARGICANYLKLTYCNACSADCSALSFVLHHFPKRLALDLDNNNLNDYGVRELQPCFSRLTVLRLSVNQITDGGVKVLSEELTKYKIVTYLGLYNNQITDVGARYVTKILDECKGLTHLKLGKNKITSEGGKYLALAVKNSKSISEVGMWGNQVGDEGAKAFAEALRNHPSLTTLSLASNGISTEGGKSLARALQQNTSLEILWLTQNELNDEVAESLAEMLKVNQTLKHLWLIQNQITAKGTAQLADALQSNTGITEICLNGNLIKPEEAKVYEDEKRIICF

SEQ ID NO: 9152 - RNA, 2862 nt, Artificial Sequence
  NOD1__Homo_sapiens__AAD28350
auggaagagcagggccacagugagauggaaauaaucccaucagagucucacccccacauucaauuacugaaaagcaaucgggaacuucuggucacucacauccgcaauacucagugucugguggacaacuugcugaagaaugacuacuucucggccgaagaugcggagauugugugugccugccccacccagccugacaagguccgcaaaauucuggaccugguacagagcaagggcgaggagguguccgaguucuuccucuacuugcuccagcaacucgcagaugccuacguggaccucaggccuuggcugcuggagaucggcuucuccccuucccugcucacucagagcaaagucguggucaacacugacccagugagcagguauacccagcagcugcgacaccaucugggccgugacuccaaguucgugcugugcuaugcccagaaggaggagcugcugcuggaggagaucuacauggacaccaucauggagcugguuggcuucagcaaugagagccugggcagccugaacagccuggccugccuccuggaccacaccaccggcauccucaaugagcagggugagaccaucuucauccugggugaugcuggggugggcaaguccaugcugcuacagcggcugcagagccucugggccacgggccggcuagacgcaggggucaaauucuucuuccacuuucgcugccgcauguucagcugcuucaaggaaagugacaggcugugucugcaggaccugcucuucaagcacuacugcuacccagagcgggaccccgaggagguguuugccuuccugcugcgcuucccccacguggcccucuucaccuucgauggccuggacgagcugcacucggacuuggaccugagccgcgugccugacagcuccugccccugggagccugcccacccccuggucuugcuggccaaccugcucagugggaagcugcucaagggggcuagcaagcugcucacagcccgcacaggcaucgaggucccgcgccaguuccugcggaagaaggugcuucuccggggcuucucccccagccaccugcgcgccuaugccaggaggauguuccccgagcgggcccugcaggaccgccugcugagccagcuggaggccaaccccaaccucugcagccugugcucugugccccucuucugcuggaucaucuuccggugcuuccagcacuuccgugcugccuuugaaggcucaccacagcugcccgacugcacgaugacccugacagaugucuuccuccuggucacugagguccaucugaacaggaugcagcccagcagccuggugcagcggaacacacgcagcccaguggagacccuccacgccggccgggacacucugugcucgcuggggcagguggcccaccggggcauggagaagagccucuuugucuucacccaggaggaggugcaggccuccgggcugcaggagagagacaugcagcugggcuuccugcgggcuuugccggagcugggccccgggggugaccagcaguccuaugaguuuuuccaccucacccuccaggccuucuuuacagccuucuuccucgugcuggacgacagggugggcacucaggagcugcucagguucuuccaggaguggaugcccccugcgggggcagcgaccacguccugcuauccucccuuccucccguuccagugccugcagggcagugguccggcgcgggaagaccucuucaagaacaaggaucacuuccaguucaccaaccucuuccugugcgggcuguuguccaaagccaaacagaaacuccugcggcaucuggugcccgcggcagcccugaggagaaagcgcaaggcccugugggcacaccuguuuuccagccugcggggcuaccugaagagccugccccgcguucaggucgaaagcuucaaccaggugcaggccaugcccacguucaucuggaugcugcgcugcaucuacgagacacagagccagaagguggggcagcuggcggccaggggcaucugcgccaacuaccucaagcugaccuacugcaacgccugcucggccgacugcagcgcccucuccuucguccugcaucacuuccccaagcggcuggcccuagaccuagacaacaacaaucucaacgacuacggcgugcgggagcugcagcccugcuucagccgccucacuguucucagacucagcguaaaccagaucacugacggugggguaaaggugcuaagcgaagagcugaccaaauacaaaauugugaccuauuuggguuuauacaacaaccagaucaccgaugucggagccagguacgucaccaaaauccuggaugaaugcaaaggccucacgcaucuuaaacugggaaaaaacaaaauaacaagugaaggagggaaguaucucgcccuggcugugaagaacagcaaaucaaucucugagguugggauguggggcaaucaaguuggggaugaaggagcaaaagccuucgcagaggcucugcggaaccaccccagcuugaccacccugagucuugcguccaacggcaucuccacagaaggaggaaagagccuugcgagggcccugcagcagaacacgucucuagaaauacuguggcugacccaaaaugaacucaacgaugaaguggcagagaguuuggcagaaauguugaaagucaaccagacguuaaagcauuuauggcuuauccagaaucagaucacagcuaaggggacugcccagcuggcagaugcguuacagagcaacacuggcauaacagagauuugccuaaauggaaaccugauaaaaccagaggaggccaaagucuaugaagaugagaagcggauuaucuguuucuga

SEQ ID NO: 9153 - RNA, 2862 nt, Artificial Sequence
  derived and/or modified sequence opt1 from NOD1__Homo_sapiens__AAD28350
auggaggagcagggccacagcgagauggagaucauccccuccgagagccacccgcacauccagcugcucaaguccaaccgcgagcugcuggugacccacauccggaacacccagugccucgucgacaaccugcugaagaacgacuacuucagcgccgaggacgccgagaucgugugcgcgugccccacgcagcccgacaaggugcgcaagauccucgaccugguccaguccaagggggaggaggugagcgaguucuuccuguaccuccugcagcagcuggccgacgccuacguggaccuccggcccuggcugcuggagaucggcuucuccccgagccuccugacccaguccaaggucguggugaacaccgaccccgucagccgcuacacccagcagcugcggcaccaccucgggcgcgacuccaaguucgugcugugcuacgcccagaaggaggagcugcuccuggaggagaucuacauggacacgaucauggagcuggugggcuucagcaacgagucccucgggagccugaacucccuggccugccuccuggaccacaccaccggcauccugaacgagcagggcgagaccaucuucauccucggggacgcgggcgucggcaagagcaugcugcugcagcggcuccagucccugugggccacggggcgccuggacgccggggugaaguucuucuuccacuuccggugccgcauguucagcugcuucaaggaguccgaccggcucugccugcaggaccugcuguucaagcacuacugcuaccccgagcgcgaccccgaggagguguucgccuuccugcugcgguucccgcacgucgcgcuguucaccuucgacggccuggacgagcugcacagcgaccucgaccugagccgcgugcccgacuccagcugccccugggagcccgcccacccgcuggugcuccuggccaaccugcuguccggcaagcuccugaagggggccagcaagcugcucaccgcccggaccggcaucgaggucccccgccaguuccugcggaagaaggugcugcuccgcggguucucccccagccaccuccgggcguacgcccgccggauguuccccgagcgcgcccugcaggaccgccuccugucccagcuggaggccaacccgaaccucugcagccugugcuccgugccccuguucugcuggaucaucuuccggugcuuccagcacuuccgcgccgcguucgagggcagcccccagcuccccgacugcacgaugacccugaccgacgucuuccugcucgugaccgaggugcaccugaaccggaugcagccguccagccugguccagcgcaacacgcggucccccguggagacccuccacgccggccgcgacacccugugcagccuggggcaggucgcccaccggggcauggagaagucccucuucguguucacccaggaggaggugcaggccagcgggcugcaggagcgcgacaugcagcugggcuuccuccgggcccugcccgagcuggggcccggcggcgaccagcaguccuacgaguucuuccaccucacgcugcaggcguucuucaccgccuucuuccugguccucgacgaccgcguggggacccaggagcugcugcgguucuuccaggaguggaugccgcccgccggcgccgccaccacgagcugcuacccgcccuuccuccccuuccagugccugcagggguccggccccgcgcgcgaggaccuguucaagaacaaggaccacuuccaguucaccaaccucuuccugugcgggcugcucagcaaggccaagcagaagcugcugcggcaccucgugcccgccgccgcgcugcgccggaagcgcaaggcccugugggcccaccucuucagcucccugcggggcuaccucaagagccucccgcgcguccagguggaguccuucaaccaggugcaggccaugcccaccuucaucuggaugcugcggugcaucuacgagacccagagccagaaggucggccagcuggccgcgcgcgggaucugcgccaacuaccucaagcugacguacugcaacgccugcuccgccgacugcagcgcccuguccuucgugcuccaccacuuccccaagcgccuggcgcuggaccucgacaacaacaaccugaacgacuacggcgugcgggagcugcagcccugcuucagccgccucaccguccugcggcuguccgugaaccagaucaccgacgggggcgugaagguccucagcgaggagcugaccaaguacaagaucgugacguaccuggggcucuacaacaaccagaucaccgacgugggcgcccgcuacgucaccaagauccuggacgagugcaagggccugacccaccucaagcuggggaagaacaagaucacguccgagggcgggaaguaccuggcccucgccgugaagaacagcaaguccaucagcgaggugggcauguggggcaaccaggucggggacgagggcgccaaggcguucgccgaggcccugcggaaccacccgucccugaccacccucagccuggccuccaacgggaucagcaccgagggcggcaagagccuggcgcgcgcccuccagcagaacaccucccuggagauccuguggcucacgcagaacgagcugaacgacgagguggccgagagccuggccgagaugcucaaggugaaccagacccugaagcaccuguggcucauccagaaccagaucaccgccaaggggaccgcgcagcuggccgacgcccugcaguccaacacgggcaucaccgagaucugccucaacgggaaccugaucaagcccgaggaggccaaggucuacgaggacgagaagcggaucaucugcuucuga

SEQ ID NO: 9154 - RNA, 2862 nt, Artificial Sequence
  derived and/or modified sequence opt2 from NOD1__Homo_sapiens__AAD28350
auggaggagcagggccacuccgagauggagaucauccccuccgagucccacccccacauccagcuccucaaguccaaccgcgagcuccucgucacccacauccgcaacacccagugccucgucgacaaccuccucaagaacgacuacuucuccgccgaggacgccgagaucgucugcgccugccccacccagcccgacaagguccgcaagauccucgaccucguccaguccaagggcgaggaggucuccgaguucuuccucuaccuccuccagcagcucgccgacgccuacgucgaccuccgccccuggcuccucgagaucggcuucucccccucccuccucacccaguccaaggucgucgucaacaccgaccccgucucccgcuacacccagcagcuccgccaccaccucggccgcgacuccaaguucguccucugcuacgcccagaaggaggagcuccuccucgaggagaucuacauggacaccaucauggagcucgucggcuucuccaacgagucccucggcucccucaacucccucgccugccuccucgaccacaccaccggcauccucaacgagcagggcgagaccaucuucauccucggcgacgccggcgucggcaaguccaugcuccuccagcgccuccagucccucugggccaccggccgccucgacgccggcgucaaguucuucuuccacuuccgcugccgcauguucuccugcuucaaggaguccgaccgccucugccuccaggaccuccucuucaagcacuacugcuaccccgagcgcgaccccgaggaggucuucgccuuccuccuccgcuucccccacgucgcccucuucaccuucgacggccucgacgagcuccacuccgaccucgaccucucccgcguccccgacuccuccugccccugggagcccgcccacccccucguccuccucgccaaccuccucuccggcaagcuccucaagggcgccuccaagcuccucaccgcccgcaccggcaucgaggucccccgccaguuccuccgcaagaagguccuccuccgcggcuucucccccucccaccuccgcgccuacgcccgccgcauguuccccgagcgcgcccuccaggaccgccuccucucccagcucgaggccaaccccaaccucugcucccucugcuccgucccccucuucugcuggaucaucuuccgcugcuuccagcacuuccgcgccgccuucgagggcuccccccagcuccccgacugcaccaugacccucaccgacgucuuccuccucgucaccgagguccaccucaaccgcaugcagcccuccucccucguccagcgcaacacccgcucccccgucgagacccuccacgccggccgcgacacccucugcucccucggccaggucgcccaccgcggcauggagaagucccucuucgucuucacccaggaggagguccaggccuccggccuccaggagcgcgacaugcagcucggcuuccuccgcgcccuccccgagcucggccccggcggcgaccagcaguccuacgaguucuuccaccucacccuccaggccuucuucaccgccuucuuccucguccucgacgaccgcgucggcacccaggagcuccuccgcuucuuccaggaguggaugccccccgccggcgccgccaccaccuccugcuacccccccuuccuccccuuccagugccuccagggcuccggccccgcccgcgaggaccucuucaagaacaaggaccacuuccaguucaccaaccucuuccucugcggccuccucuccaaggccaagcagaagcuccuccgccaccucguccccgccgccgcccuccgccgcaagcgcaaggcccucugggcccaccucuucuccucccuccgcggcuaccucaagucccucccccgcguccaggucgaguccuucaaccagguccaggccaugcccaccuucaucuggaugcuccgcugcaucuacgagacccagucccagaaggucggccagcucgccgcccgcggcaucugcgccaacuaccucaagcucaccuacugcaacgccugcuccgccgacugcuccgcccucuccuucguccuccaccacuuccccaagcgccucgcccucgaccucgacaacaacaaccucaacgacuacggcguccgcgagcuccagcccugcuucucccgccucaccguccuccgccucuccgucaaccagaucaccgacggcggcgucaagguccucuccgaggagcucaccaaguacaagaucgucaccuaccucggccucuacaacaaccagaucaccgacgucggcgcccgcuacgucaccaagauccucgacgagugcaagggccucacccaccucaagcucggcaagaacaagaucaccuccgagggcggcaaguaccucgcccucgccgucaagaacuccaaguccaucuccgaggucggcauguggggcaaccaggucggcgacgagggcgccaaggccuucgccgaggcccuccgcaaccaccccucccucaccacccucucccucgccuccaacggcaucuccaccgagggcggcaagucccucgcccgcgcccuccagcagaacaccucccucgagauccucuggcucacccagaacgagcucaacgacgaggucgccgagucccucgccgagaugcucaaggucaaccagacccucaagcaccucuggcucauccagaaccagaucaccgccaagggcaccgcccagcucgccgacgcccuccaguccaacaccggcaucaccgagaucugccucaacggcaaccucaucaagcccgaggaggccaaggucuacgaggacgagaagcgcaucaucugcuucuga

SEQ ID NO: 9155 - RNA, 2862 nt, Artificial Sequence
  derived and/or modified sequence opt3 from NOD1__Homo_sapiens__AAD28350
auggaggaacagggccacagcgagauggaaaucauucccuccgagucucauccucacauacaacugcucaagucaaacagagaacuucuggugacccauaucaggaauacacagugcuuggucgacaacuuacugaaaaaugauuacuucagugccgaggacgcugagauuguuugugcaugcccaacucagccggauaaggugcggaaaauccuagaccucguacagagcaagggggaagagguguccgaauuuuuccuguaucuucugcaacaguuggccgaugcguacgucgaccuccgccccuggcugcuggagauuggauuuucuccuucgcucuuaacgcagucaaaagugguugugaacaccgauccagucagccgauauacacagcaacugcgucaccaucuugguagagacaguaaguucguguuguguuacgcucagaaggaggaacugcuacucgaggaaaucuauauggauacuauaauggagcugguaggcuuuuccaaugaaucucuugggagccugaacuccuuggccugccuccuggaccacaccacaggaaucuuaaaugagcagggcgagaccauuuucauccugggugaugcagggguuggaaaaucaaugcuccuucagaggcugcaaaguuugugggccacuggccggcuagacgcuggcgugaaguuuuucuuucacuuccgcuguagaauguuuagcugcuucaaagaaucugauaggcugugucuccaggaccugcuuuuuaagcauuacugcuaucccgagcgggacccugaagaggucuucgcauuccuguugcgcuuuccacacguggcccucuucacauuugaugggcuggacgaauuacauuccgaucuggaccuaucacgagugcccgauagcaguuguccuugggagccagcucacccgcucguccugcuugccaacuugcugucuggaaaacuccugaagggugcguccaaacuucugaccgcaagaacgggcauugagguucccaggcaguucuugcggaaaaaggugcuccugcguggguuuagcccuucgcacuuacgcgccuacgcuagaaggauguucccagaacgggcccugcaagaccgacuacucucucagcuggaggcaaaucccaaccuuugcuccuuguguucaguaccucuguuuugcuggaucauauuccgcugcuuucagcauuucagagcugccuuugaaggaaguccacagcuccccgauuguacuaugacccugacagacguguucuuacuggucacugaggugcaccuuaauaggaugcaaccgagcuccuugguucagcggaacacccgcucuccuguggaaacacuccaugcgggcagagauacccugugcagccuaggucaggucgcccacagggggauggagaaaucacuguuuguguucacgcaggaggaaguacaagcaaguggacuccaggagcgugacaugcagcugggcuuccuucgggcuuugcccgaacugggcccagggggagaucagcaauccuacgaguuuuuccauuuaacucuccaggccuuuuucacagccuuuuuccugguucuugacgaccgaguggguacccaggagcuguugagauuuuuccaggaauggaugccucccgcuggcgcagccacuacaagcuguuauccacccuuucucccuuuccaaugccugcaggggucuggaccagcuagggaggaucuauuuaagaauaaagaccacuuccaguuuaccaaccuguuccucuguggccugcuuucaaaggcgaaacaaaaguugcugcgccacuuagucccggcagccgcucuccggagaaagaggaaagcccugugggcacaucuuuucaguagccugcgcgguuaccuaaagucccucccccgagugcaggucgaaucuuuuaaucaggugcaggccaugccuacguucauuuggaugcugcggugcaucuaugagacccaaucgcagaaaguugggcaguuggcugcccguggcauuugugcaaacuaccugaaguuaacauauugcaacgcguguagcgcugauugcuccgcccucucauuugugcugcaccauuucccaaaaagacuugcacuggacuuggauaauaacaaucucaacgacuacggaguaagggaacugcagcccuguuuuagucgccuaacuguccugcggcuuucugugaaucaaaucaccgauggcgggguuaaggugcucagcgaggagcugacaaaguauaaaaucgucacuuacuugggacuguacaacaaucagauuaccgacgugggugccagauauguaacaaagauauuagaugaaugcaaaggccucacccaccugaaacuugggaagaacaagaucacuuccgagggaggcaaguaccuggcuuuggccgugaaaaauucaaagagcauuucugaaguugguaugugggggaaccaggucggcgacgagggagcaaaggcuuucgccgaagcgcucaggaaucacccuucccugacgacacuaagucuggccagcaacggcaucucuaccgaagggggaaagucccuugcucgagcacuccagcaaaauacuucacuggagauauugugguuaacccagaacgagcugaaugaugagguggccgaaagucucgcugagaugcugaaagugaaccagacacuuaagcaucugugguugauucaaaaccagaucaccgccaaggguacugcacagcuagcggacgcccugcagagcaauacaggcaucacggaaauuugccucaacgggaaucugaucaaaccagaggaggcuaaggucuaugaagaugagaaacgcauuauauguuuuuga

SEQ ID NO: 9156 - RNA, 2862 nt, Artificial Sequence
  derived and/or modified sequence opt4 from NOD1__Homo_sapiens__AAD28350
auggaggagcagggccacagcgagauggagaucauccccagcgagagccacccccacauccagcugcugaagagcaacagagagcugcuggugacccacaucagaaacacccagugccugguggacaaccugcugaagaacgacuacuucagcgccgaggacgccgagaucgugugcgccugccccacccagcccgacaaggugagaaagauccuggaccuggugcagagcaagggcgaggaggugagcgaguucuuccuguaccugcugcagcagcuggccgacgccuacguggaccugagacccuggcugcuggagaucggcuucagccccagccugcugacccagagcaaggugguggugaacaccgaccccgugagcagauacacccagcagcugagacaccaccugggcagagacagcaaguucgugcugugcuacgcccagaaggaggagcugcugcuggaggagaucuacauggacaccaucauggagcuggugggcuucagcaacgagagccugggcagccugaacagccuggccugccugcuggaccacaccaccggcauccugaacgagcagggcgagaccaucuucauccugggcgacgccggcgugggcaagagcaugcugcugcagagacugcagagccugugggccaccggcagacuggacgccggcgugaaguucuucuuccacuucagaugcagaauguucagcugcuucaaggagagcgacagacugugccugcaggaccugcuguucaagcacuacugcuaccccgagagagaccccgaggagguguucgccuuccugcugagauucccccacguggcccuguucaccuucgacggccuggacgagcugcacagcgaccuggaccugagcagagugcccgacagcagcugccccugggagcccgcccacccccuggugcugcuggccaaccugcugagcggcaagcugcugaagggcgccagcaagcugcugaccgccagaaccggcaucgaggugcccagacaguuccugagaaagaaggugcugcugagaggcuucagccccagccaccugagagccuacgccagaagaauguuccccgagagagcccugcaggacagacugcugagccagcuggaggccaaccccaaccugugcagccugugcagcgugccccuguucugcuggaucaucuucagaugcuuccagcacuucagagccgccuucgagggcagcccccagcugcccgacugcaccaugacccugaccgacguguuccugcuggugaccgaggugcaccugaacagaaugcagcccagcagccuggugcagagaaacaccagaagccccguggagacccugcacgccggcagagacacccugugcagccugggccagguggcccacagaggcauggagaagagccuguucguguucacccaggaggaggugcaggccagcggccugcaggagagagacaugcagcugggcuuccugagagcccugcccgagcugggccccggcggcgaccagcagagcuacgaguucuuccaccugacccugcaggccuucuucaccgccuucuuccuggugcuggacgacagagugggcacccaggagcugcugagauucuuccaggaguggaugccccccgccggcgccgccaccaccagcugcuacccccccuuccugcccuuccagugccugcagggcagcggccccgccagagaggaccuguucaagaacaaggaccacuuccaguucaccaaccuguuccugugcggccugcugagcaaggccaagcagaagcugcugagacaccuggugcccgccgccgcccugagaagaaagagaaaggcccugugggcccaccuguucagcagccugagaggcuaccugaagagccugcccagagugcagguggagagcuucaaccaggugcaggccaugcccaccuucaucuggaugcugagaugcaucuacgagacccagagccagaaggugggccagcuggccgccagaggcaucugcgccaacuaccugaagcugaccuacugcaacgccugcagcgccgacugcagcgcccugagcuucgugcugcaccacuuccccaagagacuggcccuggaccuggacaacaacaaccugaacgacuacggcgugagagagcugcagcccugcuucagcagacugaccgugcugagacugagcgugaaccagaucaccgacggcggcgugaaggugcugagcgaggagcugaccaaguacaagaucgugaccuaccugggccuguacaacaaccagaucaccgacgugggcgccagauacgugaccaagauccuggacgagugcaagggccugacccaccugaagcugggcaagaacaagaucaccagcgagggcggcaaguaccuggcccuggccgugaagaacagcaagagcaucagcgaggugggcauguggggcaaccaggugggcgacgagggcgccaaggccuucgccgaggcccugagaaaccaccccagccugaccacccugagccuggccagcaacggcaucagcaccgagggcggcaagagccuggccagagcccugcagcagaacaccagccuggagauccuguggcugacccagaacgagcugaacgacgagguggccgagagccuggccgagaugcugaaggugaaccagacccugaagcaccuguggcugauccagaaccagaucaccgccaagggcaccgcccagcuggccgacgcccugcagagcaacaccggcaucaccgagaucugccugaacggcaaccugaucaagcccgaggaggccaagguguacgaggacgagaagagaaucaucugcuucuga

SEQ ID NO: 9157 - RNA, 2862 nt, Artificial Sequence
  derived and/or modified sequence opt5 from NOD1__Homo_sapiens__AAD28350
auggaggaacagggccacagcgagauggaaaucauucccuccgagucucauccucacauccaacugcucaagagcaacagagaacugcuugugacccauauucggaauacacagugccuggucgacaaccuccugaaaaaugauuacuucuccgccgaggacgcugagaucguuugugccugcccgacgcagcccgauaaggugcgcaaaauucuugaccuggugcagucuaagggggaagaggucagcgaauuuuuccucuaucugcugcaacagcucgcggaugcuuacguggaccugagaccuuggcuucuggagaucggauuuucccccucucuccugacccagagcaaaguuguggucaacacagauccugugucccgguauacccagcaacuucgccaccaucugggcagagacagcaaguucguucucuguuacgcccagaaggaggaacugcugcucgaggaaaucuauauggauacaauuauggagcuggugggguuuucuaaugaaucccuuggaagccugaacucucucgccugccugcuugaccacaccacaggcauccugaaugagcagggggagaccauuuucauccucggagaugcuggcgucggcaaauccaugcugcugcagcggcuccaaagccugugggccacggggcgccuugacgcuggagugaaguuuuucuuucacuucagaugucggauguuuucuugcuucaaagaauccgaucgccugugucuccaggaccugcuuuuuaagcauuacugcuaucccgagagagacccugaagagguguucgccuuccugcuccgguuuccgcacgucgcgcuguucaccuuugauggccuggacgaacuccauagcgaucuggaccuuucccgcguucccgauucuagcuguccuugggagcccgcccacccucuggugcuccuggcuaaccugcuuuccgggaaacuccugaagggagccagcaagcugcucacagcuagaaccggcauugaggugccccggcaguuccugcgcaaaaagguccuucugagaggguuuucuccgucccaccuccgggccuacgcgagacgcauguucccugaacgggcccugcaagacagacugcuuagccagcucgaggcuaaucccaaccugugcucucuguguagcgugccucucuuuugcuggaucauuuuccgcugcuuucagcauuuccgggccgcuuuugaaggaagcccccagcugcccgauuguacaaugacccuuacggacguuuuccugcucgugacagagguccaccugaauagaaugcaaccuucuagccuggugcagcgcaacacccgguccccgguugaaacacuucaugccggcagagauacccucugcagccugggccagguggcccaccgcgggauggagaaaucucuguuugucuucacccaggaggaagugcaggcuuccggacuccaagagcgggacaugcagcugggcuuccuuagagcgcugcccgaacucgggccuggaggcgaucagcaaagcuacgaguuuuuccaucugacacugcaggccuuuuucacggccuuuuuccuuguccucgacgaccgcguggggacccaggagcugcugcgguuuuuccaggaauggaugcccccugcuggagccgcuacaaccucuuguuaucccccguuucucccuuuccaaugccugcagggcuccggccccgccagagaggaucuuuuuaagaauaaagaccacuuccaguuuacaaaccuguuccucugugggcugcugagcaaggcgaaacaaaaacuucugcggcaccucguuccugcugccgcccugcgcagaaagcggaaagcucucugggcccaucuguucuccucucuuagaggauaccugaagucccucccccgcgugcaggucgaauccuuuaaucaggugcaggcuaugccuaccuucaucuggaugcugcggugcaucuaugagacgcaaucucagaaaguuggccagcuggccgcgagagggauuugugccaacuaccuuaagcugacauauugcaacgcuuguagcgccgauugcuccgcucucagcuuugugcugcaccauuuccccaaacgccucgcccuggaccuugauaauaacaaucugaacgacuacggagucagagaacuccagccguguuuuucucggcugaccgugcugcgccuuuccgugaaucaaaucaccgauggcgggguuaagguccugagcgaggagcucacaaaguauaaaauugugaccuaccugggccucuacaacaaucagaucacagacgugggagcgagauaugucacgaagauucuggaugaaugcaaaggccuuacccaccugaagcuggggaaaaacaagaucacaucugagggaggcaaguaccucgcccuggcugugaaaaauuccaagagcaucucugaaguugggauguggggaaaccaggugggcgacgagggggccaaggcuuucgccgaagcccuucggaaucacccuagccugaccacacucucccuggcuagcaacggcauuucuaccgagggaggcaagucccucgcgcgcgcccugcagcaaaauacgagccuugagauccuguggcugacccagaacgaacucaaugaugaggucgcugaaucccuggccgagaugcuuaaagugaaccagacacugaagcaucucuggcugauucaaaaccagaucaccgccaaggggacagcucagcucgccgacgcgcugcagucuaauaccggaauuacggaaaucugccuuaacggcaaucugaucaaacccgaggaggcuaagguuuaugaagaugagaaaagaauuaucuguuuuuga

SEQ ID NO: 9158 - protein, 1040 aa, Artificial Sequence
  NOD2__Homo_sapiens__Q9HC29
MGEEGGSASHDEEERASVLLGHSPGCEMCSQEAFQAQRSQLVELLVSGSLEGFESVLDWLLSWEVLSWEDYEGFHLLGQPLSHLARRLLDTVWNKGTWACQKLIAAAQEAQADSQSPKLHGCWDPHSLHPARDLQSHRPAIVRRLHSHVENMLDLAWERGFVSQYECDEIRLPIFTPSQRARRLLDLATVKANGLAAFLLQHVQELPVPLALPLEAATCKKYMAKLRTTVSAQSRFLSTYDGAETLCLEDIYTENVLEVWADVGMAGPPQKSPATLGLEELFSTPGHLNDDADTVLVVGEAGSGKSTLLQRLHLLWAAGQDFQEFLFVFPFSCRQLQCMAKPLSVRTLLFEHCCWPDVGQEDIFQLLLDHPDRVLLTFDGFDEFKFRFTDRERHCSPTDPTSVQTLLFNLLQGNLLKNARKVVTSRPAAVSAFLRKYIRTEFNLKGFSEQGIELYLRKRHHEPGVADRLIRLLQETSALHGLCHLPVFSWMVSKCHQELLLQEGGSPKTTTDMYLLILQHFLLHATPPDSASQGLGPSLLRGRLPTLLHLGRLALWGLGMCCYVFSAQQLQAAQVSPDDISLGFLVRAKGVVPGSTAPLEFLHITFQCFFAAFYLALSADVPPALLRHLFNCGRPGNSPMARLLPTMCIQASEGKDSSVAALLQKAEPHNLQITAAFLAGLLSREHWGLLAECQTSEKALLRRQACARWCLARSLRKHFHSIPPAAPGEAKSVHAMPGFIWLIRSLYEMQEERLARKAARGLNVGHLKLTFCSVGPTECAALAFVLQHLRRPVALQLDYNSVGDIGVEQLLPCLGVCKALYLRDNNISDRGICKLIECALHCEQLQKLALFNNKLTDGCAHSMAKLLACRQNFLALRLGNNYITAAGAQVLAEGLRGNTSLQFLGFWGNRVGDEGAQALAEALGDHQSLRWLSLVGNNIGSVGAQALALMLAKNVMLEELCLEENHLQDEGVCSLAEGLKKNSSLKILKLSNNCITYLGAEALLQALERNDTILEVWLRGNTFSLEEVDKLGCRDTRLLL

SEQ ID NO: 9159 - RNA, 3123 nt, Artificial Sequence
  NOD2__Homo_sapiens__AAG33677
augggggaagagggugguucagccucucacgaugaggaggaaagagcaaguguccuccucggacauucuccggguugugaaaugugcucgcaggaggcuuuucaggcacagaggagccagcuggucgagcugcuggucucagggucccuggaaggcuucgagaguguccuggacuggcugcuguccugggagguccucuccugggaggacuacgagggcuuccaccuccugggccagccucucucccacuuggccaggcgccuucuggacaccgucuggaauaaggguacuugggccugucagaagcucaucgcggcugcccaagaagcccaggccgacagccagucccccaagcugcauggcugcugggacccccacucgcuccacccagcccgagaccugcagagucaccggccagccauugucaggaggcuccacagccauguggagaacaugcuggaccuggcaugggagcgggguuucgucagccaguaugaaugugaugaaaucagguugccgaucuucacaccgucccagagggcaagaaggcugcuugaucuugccacggugaaagcgaauggauuggcugccuuccuucuacaacauguucaggaauuaccagucccauuggcccugccuuuggaagcugccacaugcaagaaguauauggccaagcugaggaccacggugucugcucagucucgcuuccucaguaccuaugauggagcagagacgcucugccuggaggacauauacacagagaauguccuggaggucugggcagaugugggcauggcuggacccccgcagaagagcccagccacccugggccuggaggagcucuucagcaccccuggccaccucaaugacgaugcggacacugugcugguggugggugaggcgggcaguggcaagagcacgcuccugcagcggcugcacuugcugugggcugcagggcaagacuuccaggaauuucucuuugucuucccauucagcugccggcagcugcagugcauggccaaaccacucucugugcggacucuacucuuugagcacugcuguuggccugauguuggucaagaagacaucuuccaguuacuccuugaccacccugaccguguccuguuaaccuuugauggcuuugacgaguucaaguucagguucacggaucgugaacgccacugcuccccgaccgaccccaccucuguccagacccugcucuucaaccuucugcagggcaaccugcugaagaaugcccgcaagguggugaccagccguccggccgcugugucggcguuccucaggaaguacauccgcaccgaguucaaccucaagggcuucucugaacagggcaucgagcuguaccugaggaagcgccaucaugagcccgggguggcggaccgccucauccgccugcuccaagagaccucagcccugcacgguuugugccaccugccugucuucucauggaugguguccaaaugccaccaggaacuguugcugcaggaggggggguccccaaagaccacuacagauauguaccugcugauucugcagcauuuucugcugcaugccacccccccagacucagcuucccaaggucugggacccagucuucuucggggccgccuccccacccuccugcaccugggcagacuggcucuguggggccugggcaugugcugcuacguguucucagcccagcagcuccaggcagcacaggucagcccugaugacauuucucuuggcuuccuggugcgugccaaaggugucgugccagggaguacggcgccccuggaauuccuucacaucacuuuccagugcuucuuugccgcguucuaccuggcacucagugcugaugugccaccagcuuugcucagacaccucuucaauuguggcaggccaggcaacucaccaauggccaggcuccugcccacgaugugcauccaggccucggagggaaaggacagcagcguggcagcuuugcugcagaaggccgagccgcacaaccuucagaucacagcagccuuccuggcagggcuguugucccgggagcacuggggccugcuggcugagugccagacaucugagaaggcccugcuccggcgccaggccugugcccgcuggugucuggcccgcagccuccgcaagcacuuccacuccaucccgccagcugcaccgggugaggccaagagcgugcaugccaugcccggguucaucuggcucauccggagccuguacgagaugcaggaggagcggcuggcucggaaggcugcacguggccugaauguugggcaccucaaguugacauuuugcagugugggccccacugagugugcugcccuggccuuugugcugcagcaccuccggcggcccguggcccugcagcuggacuacaacucugugggugacauuggcguggagcagcugcugccuugccuuggugucugcaaggcucuguauuugcgcgauaacaauaucucagaccgaggcaucugcaagcucauugaaugugcucuucacugcgagcaauugcagaaguuagcucuauucaacaacaaauugacugacggcugugcacacuccauggcuaagcuccuugcaugcaggcagaacuucuuggcauugaggcuggggaauaacuacaucacugccgcgggagcccaagugcuggccgaggggcuccgaggcaacaccuccuugcaguuccugggauucuggggcaacagagugggugacgagggggcccaggcccuggcugaagccuugggugaucaccagagcuugagguggcucagccugguggggaacaacauuggcagugugggugcccaagccuuggcacugaugcuggcaaagaacgucaugcuagaagaacucugccuggaggagaaccaucuccaggaugaagguguauguucucucgcagaaggacugaagaaaaauucaaguuugaaaauccugaaguuguccaauaacugcaucaccuaccuaggggcagaagcccuccugcaggcccuugaaaggaaugacaccauccuggaagucuggcuccgagggaacacuuucucucuagaggagguugacaagcucggcugcagggacaccagacucuugcuuuga

SEQ ID NO: 9160 - RNA, 3123 nt, Artificial Sequence
  derived and/or modified sequence opt1 from NOD2__Homo_sapiens__AAG33677
augggcgaggagggcgggagcgccucccacgacgaggaggagcgcgccagcgugcugcucgggcacucccccggcugcgagaugugcagccaggaggcguuccaggcccagcggucccagcuggucgagcugcucgugagcgggucccuggagggcuucgagagcgugcuggacuggcuccuguccugggagguccugagcugggaggacuacgagggcuuccaccuccuggggcagccgcugucccaccucgcccgccggcugcuggacaccguguggaacaagggcaccugggccugccagaagcucaucgccgcggcccaggaggcccaggccgacagccagucccccaagcugcacgggugcugggacccccacagccugcaccccgcgcgcgaccuccagucccaccggccggccaucgugcgccggcugcacagccacgucgagaacaugcuggaccucgccugggagcgcggcuucgugucccaguacgagugcgacgagauccggcugcccaucuucacgcccagccagcgcgcccggcgccugcucgaccuggccaccgugaaggcgaacgggcuggccgccuuccuccugcagcacguccaggagcugcccgugccgcucgcccugccccuggaggccgcgaccugcaagaaguacauggccaagcuccggaccacgguguccgcccagagccgcuuccugagcaccuacgacggcgccgagacccugugccucgaggacaucuacaccgagaacguccuggaggugugggccgacgugggcauggcggggccgccccagaagucccccgccacgcugggccucgaggagcuguucagcacccccgggcaccugaacgacgacgccgacaccguccucguggugggcgaggccggcuccggcaagagcacccugcugcagcggcuccaccuccugugggccgcggggcaggacuuccaggaguuccucuucgucuuccccuucuccugccgccagcugcagugcauggccaagccccugagcgugcggacgcugcuguucgagcacugcugcuggccggacguggggcaggaggacaucuuccagcugcugcucgaccaccccgaccgcguccugcugaccuucgacggcuucgacgaguucaaguuccgguucaccgaccgcgagcggcacugcucccccaccgaccccacgagcgugcagacccuccuguucaaccugcuccaggggaaccugcugaagaacgcccgcaagguggucaccucccgcccggccgcggugagcgccuuccuccggaaguacauccgcaccgaguucaaccugaagggcuucuccgagcagggcaucgagcuguaccuccggaagcgccaccacgagcccggggucgccgaccggcugauccgccugcuccaggagacgagcgcccugcacggccugugccaccuccccguguucuccuggauggugagcaagugccaccaggagcugcugcuccaggagggcgggucccccaagaccaccaccgacauguaccugcugauccuccagcacuuccugcugcacgccacgccgcccgacagcgcgucccaggggcucggccccagccugcugcggggccgccuccccacccugcugcaccucgggcggcuggcccuguggggccucgggaugugcugcuacgucuucuccgcccagcagcugcaggccgcccaggugagcccggacgacaucagccugggcuuccucgugcgcgcgaagggggucgugcccggcuccaccgcgccccuggaguuccugcacaucaccuuccagugcuucuucgccgccuucuaccucgcccugagcgcggacgugccgcccgcccugcuccggcaccuguucaacugcggccgccccgggaacucccccauggcccggcugcucccgacgaugugcauccaggccagcgagggcaaggacuccagcgucgcggcccugcugcagaaggccgagccccacaaccuccagaucaccgccgccuuccuggcggggcugcucucccgcgagcacuggggccugcuggccgagugccagaccagcgagaaggcccuccugcggcgccaggccugcgcccgguggugccuggcgcgcucccuccggaagcacuuccacagcaucccgcccgccgcccccggcgaggccaaguccgugcacgccaugcccggguucaucuggcugauccgcagccuguacgagaugcaggaggagcgccucgcgcggaaggccgcccgcggccugaacguggggcaccugaagcucaccuucugcuccgucggccccacggagugcgccgcgcuggccuucgugcugcagcaccuccggcgccccguggcccugcagcuggacuacaacagcgucggggacaucggcguggagcagcuccugccgugccugggcgugugcaaggcccucuaccugcgggacaacaacaucuccgaccgcgggaucugcaagcugaucgagugcgcccuccacugcgagcagcugcagaagcuggcccucuucaacaacaagcugaccgacggcugcgcccacagcauggccaagcugcucgccugccggcagaacuuccuggcccugcgccucgggaacaacuacaucaccgcggccggcgcccagguccuggccgaggggcugcggggcaacaccucccuccaguuccugggcuucugggggaaccgcgugggcgacgagggggcccaggcgcuggccgaggcccugggcgaccaccagagccuccgguggcugagccugguggggaacaacaucggcuccgucggcgcccaggcccucgcgcugaugcuggccaagaacgugaugcucgaggagcugugccuggaggagaaccaccuccaggacgagggggugugcagccuggccgagggccugaagaagaacuccagccucaagauccugaagcuguccaacaacugcaucacguaccucggggccgaggcgcugcugcaggcccucgagcgcaacgacaccauccuggaggucuggcugcggggcaacaccuucagccucgaggagguggacaagcuggggugccgcgacacccggcugcuccuguga

SEQ ID NO: 9161 - RNA, 3123 nt, Artificial Sequence
  derived and/or modified sequence opt2 from NOD2__Homo_sapiens__AAG33677
augggcgaggagggcggcuccgccucccacgacgaggaggagcgcgccuccguccuccucggccacucccccggcugcgagaugugcucccaggaggccuuccaggcccagcgcucccagcucgucgagcuccucgucuccggcucccucgagggcuucgaguccguccucgacuggcuccucuccugggagguccucuccugggaggacuacgagggcuuccaccuccucggccagccccucucccaccucgcccgccgccuccucgacaccgucuggaacaagggcaccugggccugccagaagcucaucgccgccgcccaggaggcccaggccgacucccagucccccaagcuccacggcugcugggacccccacucccuccaccccgcccgcgaccuccagucccaccgccccgccaucguccgccgccuccacucccacgucgagaacaugcucgaccucgccugggagcgcggcuucgucucccaguacgagugcgacgagauccgccuccccaucuucacccccucccagcgcgcccgccgccuccucgaccucgccaccgucaaggccaacggccucgccgccuuccuccuccagcacguccaggagcuccccgucccccucgcccucccccucgaggccgccaccugcaagaaguacauggccaagcuccgcaccaccgucuccgcccagucccgcuuccucuccaccuacgacggcgccgagacccucugccucgaggacaucuacaccgagaacguccucgaggucugggccgacgucggcauggccggccccccccagaagucccccgccacccucggccucgaggagcucuucuccacccccggccaccucaacgacgacgccgacaccguccucgucgucggcgaggccggcuccggcaaguccacccuccuccagcgccuccaccuccucugggccgccggccaggacuuccaggaguuccucuucgucuuccccuucuccugccgccagcuccagugcauggccaagccccucuccguccgcacccuccucuucgagcacugcugcuggcccgacgucggccaggaggacaucuuccagcuccuccucgaccaccccgaccgcguccuccucaccuucgacggcuucgacgaguucaaguuccgcuucaccgaccgcgagcgccacugcucccccaccgaccccaccuccguccagacccuccucuucaaccuccuccagggcaaccuccucaagaacgcccgcaaggucgucaccucccgccccgccgccgucuccgccuuccuccgcaaguacauccgcaccgaguucaaccucaagggcuucuccgagcagggcaucgagcucuaccuccgcaagcgccaccacgagcccggcgucgccgaccgccucauccgccuccuccaggagaccuccgcccuccacggccucugccaccuccccgucuucuccuggauggucuccaagugccaccaggagcuccuccuccaggagggcggcucccccaagaccaccaccgacauguaccuccucauccuccagcacuuccuccuccacgccaccccccccgacuccgccucccagggccucggccccucccuccuccgcggccgccuccccacccuccuccaccucggccgccucgcccucuggggccucggcaugugcugcuacgucuucuccgcccagcagcuccaggccgcccaggucucccccgacgacaucucccucggcuuccucguccgcgccaagggcgucguccccggcuccaccgccccccucgaguuccuccacaucaccuuccagugcuucuucgccgccuucuaccucgcccucuccgccgacgucccccccgcccuccuccgccaccucuucaacugcggccgccccggcaacucccccauggcccgccuccuccccaccaugugcauccaggccuccgagggcaaggacuccuccgucgccgcccuccuccagaaggccgagccccacaaccuccagaucaccgccgccuuccucgccggccuccucucccgcgagcacuggggccuccucgccgagugccagaccuccgagaaggcccuccuccgccgccaggccugcgcccgcuggugccucgcccgcucccuccgcaagcacuuccacuccaucccccccgccgcccccggcgaggccaaguccguccacgccaugcccggcuucaucuggcucauccgcucccucuacgagaugcaggaggagcgccucgcccgcaaggccgcccgcggccucaacgucggccaccucaagcucaccuucugcuccgucggccccaccgagugcgccgcccucgccuucguccuccagcaccuccgccgccccgucgcccuccagcucgacuacaacuccgucggcgacaucggcgucgagcagcuccuccccugccucggcgucugcaaggcccucuaccuccgcgacaacaacaucuccgaccgcggcaucugcaagcucaucgagugcgcccuccacugcgagcagcuccagaagcucgcccucuucaacaacaagcucaccgacggcugcgcccacuccauggccaagcuccucgccugccgccagaacuuccucgcccuccgccucggcaacaacuacaucaccgccgccggcgcccagguccucgccgagggccuccgcggcaacaccucccuccaguuccucggcuucuggggcaaccgcgucggcgacgagggcgcccaggcccucgccgaggcccucggcgaccaccagucccuccgcuggcucucccucgucggcaacaacaucggcuccgucggcgcccaggcccucgcccucaugcucgccaagaacgucaugcucgaggagcucugccucgaggagaaccaccuccaggacgagggcgucugcucccucgccgagggccucaagaagaacuccucccucaagauccucaagcucuccaacaacugcaucaccuaccucggcgccgaggcccuccuccaggcccucgagcgcaacgacaccauccucgaggucuggcuccgcggcaacaccuucucccucgaggaggucgacaagcucggcugccgcgacacccgccuccuccucuga

SEQ ID NO: 9162 - RNA, 3123 nt, Artificial Sequence
  derived and/or modified sequence opt3 from NOD2__Homo_sapiens__AAG33677
augggcgaggaagggggaagcgccucccacgacgaggaagagagagcuucugugcugcucggucauucacccggcugcgaaauguguagucaggaggcauuccaagcccagaggagccagcuugucgagcuguugguuuccgggucuuuagaaggauuugagucggugcuggauuggcuacucucaugggaaguacugagcugggaggacuacgagggcuuccaccuucugggucagccuuugagucaucucgcgcggcgccugcuggauaccguguggaacaaggggacaugggcuugccaaaaacucaucgccgcagcccaggaagcucaggcagacucccagucuccaaaguuacacggauguugggauccgcauagccugcaccccgcccgagaccuucaaucccaccguccugcuauugucagaagguugcauucacacguggagaauaugcuggaucuagccugggaacggggcuuuguuagucaguaugagugcgacgaaauacgccucccaaucuucacucccagccagagagcgaggcggcugcuugaucuggcaacggugaaagccaacggcuuggcugccuuucuccugcagcauguccaagaguuaccugugccacuggcacucccccuugaggcugccaccuguaagaaauacauggcgaagcugcgcacaacuguaucugcccagucccgauucuugucaaccuaugacggggcagaaacacuaugccuggaggauauuuacaccgaaaauguucucgaggugugggcugacgucggaauggccgguccuccacagaagucuccggcuacucugggccuugaggagcuguuuaguacacccgggcacuugaacgaugacgccgacaccgugcucguggucggagaggcaggcucugguaaauccacgcuguuacaaagacugcaccuacucugggccgcugggcaggauuuccaggaauuucuguucguuuuuccuuucagcuguaggcagcuucaaugcauggcgaagccauugucggugcggacucugcucuuugagcauuguugcuggcccgacguaggacaggaagauaucuuccagcugcuucuggaccacccugaucguguguugcucaccuucgacggcuuugaugaguucaaauuucgcuucacagacagagaaaggcauuguucuccaacugaucccaccuccguccagacacuguuauuuaaucugcuacaaggcaaccuccugaagaaugcacggaaagugguuaccucacgaccggccgcugugagugccuuccuucgcaaguauauuagaacggaguuuaacuugaagggguucagcgagcagggaaucgaacuguaccucaggaaacggcaccaugagccuggugucgcagaccgccugauaagauuacugcaggaaacuuccgcccuucacggcuugugccaccuccccguguuuucuuggaugguaagcaagugccaucaggagcugcuacugcaagaagggggaucaccaaaaacaaccacugauauguaucuccugauccuucagcacuucuugcugcaugcuacaccucccgacagugccucccagggcuuagguccaagccuccugagggggcgucuucccacccuguugcaccucggccggcuggcacuauggggacugggcauguguugcuacguuuuuagcgcgcagcaacuccaggcugcccaggugucaccugacgauauuagucugggguuccuuguccgagcaaagggaguggucccagguagcacggccccguuggaauuucugcacaucaccuuccaauguuucuuugcugccuucuacuuagcacucuccgcugacgugcccccugcccugcuuagacaucuguuuaauugcggcaggccagggaacucucccauggcgcgccuacucccuacaauguguauucaggccucggagggaaaagauagcuccguugcugcacuguugcagaaggccgaaccacacaaucugcagaucacugcugccuucuuagcaggccuccugucacgggagcauuggggucuucuggcggaaugccaaaccagugagaaagccuugcucagaaggcaggcuugugcccgcuggugccuggcacgaucucuacggaagcacuuucauagcauacccccggcugccccuggggaggcaaaguccgugcacgccaugccaggcuucauuuggcugauccguucacuuuaugaaaugcaggaggaaagacucgcuaggaaagcggcccgcggacugaacguaggccacuugaagcugacauuuuguagcgucgggcccacugagugcgcagcuuuagccuucgugcuccagcaucugcggagaccuguugcccuucaacuggacuacaauucugugggagauauuggugucgaacaguugcuccccugucugggcgugugcaaagcucuauaucugagggacaacaauaucuccgaucgagggaucugcaaacuuauugagugugcacuccacugcgagcagcugcagaaauuggccuuauuuaacaacaagcugaccgacggaugugcgcauaguauggcuaagcuccuggccugccgccaaaauuuccuugcacugcgguugggcaacaauuacauaacagccgcuggugcacagguacuagccgaagggcugagaggcaacaccagccuccaguuucugggauucuggggcaauagggugggggaugagggagcgcaagcucuugccgaagcauuaggcgaccaccagucucugcguuggcucuccuugguugguaacaauaucgggucagucggagcccaggcucuggcccucaugcuggcaaagaacgugaugcuugaggaacuguguuuggaggagaaucaucuacaggaugaaggcgugugcagucuggcugagggucucaagaaaaacagcucguuaaagauucugaaacuuuccaauaacuguaucacuuaucugggcgccgaagcgcucuugcaagcccuggagcgcaaugacacgauacucgaggucuggcugcgggggaacacauuuucucuugaagagguugauaagcuaggaugcagagacaccaggcuguuguuauga

SEQ ID NO: 9163 - RNA, 3123 nt, Artificial Sequence
  derived and/or modified sequence opt4 from NOD2__Homo_sapiens__AAG33677
augggcgaggagggcggcagcgccagccacgacgaggaggagagagccagcgugcugcugggccacagccccggcugcgagaugugcagccaggaggccuuccaggcccagagaagccagcugguggagcugcuggugagcggcagccuggagggcuucgagagcgugcuggacuggcugcugagcugggaggugcugagcugggaggacuacgagggcuuccaccugcugggccagccccugagccaccuggccagaagacugcuggacaccguguggaacaagggcaccugggccugccagaagcugaucgccgccgcccaggaggcccaggccgacagccagagccccaagcugcacggcugcugggacccccacagccugcaccccgccagagaccugcagagccacagacccgccaucgugagaagacugcacagccacguggagaacaugcuggaccuggccugggagagaggcuucgugagccaguacgagugcgacgagaucagacugcccaucuucacccccagccagagagccagaagacugcuggaccuggccaccgugaaggccaacggccuggccgccuuccugcugcagcacgugcaggagcugcccgugccccuggcccugccccuggaggccgccaccugcaagaaguacauggccaagcugagaaccaccgugagcgcccagagcagauuccugagcaccuacgacggcgccgagacccugugccuggaggacaucuacaccgagaacgugcuggaggugugggccgacgugggcauggccggccccccccagaagagccccgccacccugggccuggaggagcuguucagcacccccggccaccugaacgacgacgccgacaccgugcugguggugggcgaggccggcagcggcaagagcacccugcugcagagacugcaccugcugugggccgccggccaggacuuccaggaguuccuguucguguuccccuucagcugcagacagcugcagugcauggccaagccccugagcgugagaacccugcuguucgagcacugcugcuggcccgacgugggccaggaggacaucuuccagcugcugcuggaccaccccgacagagugcugcugaccuucgacggcuucgacgaguucaaguucagauucaccgacagagagagacacugcagccccaccgaccccaccagcgugcagacccugcuguucaaccugcugcagggcaaccugcugaagaacgccagaaagguggugaccagcagacccgccgccgugagcgccuuccugagaaaguacaucagaaccgaguucaaccugaagggcuucagcgagcagggcaucgagcuguaccugagaaagagacaccacgagcccggcguggccgacagacugaucagacugcugcaggagaccagcgcccugcacggccugugccaccugcccguguucagcuggauggugagcaagugccaccaggagcugcugcugcaggagggcggcagccccaagaccaccaccgacauguaccugcugauccugcagcacuuccugcugcacgccaccccccccgacagcgccagccagggccugggccccagccugcugagaggcagacugcccacccugcugcaccugggcagacuggcccuguggggccugggcaugugcugcuacguguucagcgcccagcagcugcaggccgcccaggugagccccgacgacaucagccugggcuuccuggugagagccaagggcguggugcccggcagcaccgccccccuggaguuccugcacaucaccuuccagugcuucuucgccgccuucuaccuggcccugagcgccgacgugccccccgcccugcugagacaccuguucaacugcggcagacccggcaacagccccauggccagacugcugcccaccaugugcauccaggccagcgagggcaaggacagcagcguggccgcccugcugcagaaggccgagccccacaaccugcagaucaccgccgccuuccuggccggccugcugagcagagagcacuggggccugcuggccgagugccagaccagcgagaaggcccugcugagaagacaggccugcgccagauggugccuggccagaagccugagaaagcacuuccacagcaucccccccgccgcccccggcgaggccaagagcgugcacgccaugcccggcuucaucuggcugaucagaagccuguacgagaugcaggaggagagacuggccagaaaggccgccagaggccugaacgugggccaccugaagcugaccuucugcagcgugggccccaccgagugcgccgcccuggccuucgugcugcagcaccugagaagacccguggcccugcagcuggacuacaacagcgugggcgacaucggcguggagcagcugcugcccugccugggcgugugcaaggcccuguaccugagagacaacaacaucagcgacagaggcaucugcaagcugaucgagugcgcccugcacugcgagcagcugcagaagcuggcccuguucaacaacaagcugaccgacggcugcgcccacagcauggccaagcugcuggccugcagacagaacuuccuggcccugagacugggcaacaacuacaucaccgccgccggcgcccaggugcuggccgagggccugagaggcaacaccagccugcaguuccugggcuucuggggcaacagagugggcgacgagggcgcccaggcccuggccgaggcccugggcgaccaccagagccugagauggcugagccuggugggcaacaacaucggcagcgugggcgcccaggcccuggcccugaugcuggccaagaacgugaugcuggaggagcugugccuggaggagaaccaccugcaggacgagggcgugugcagccuggccgagggccugaagaagaacagcagccugaagauccugaagcugagcaacaacugcaucaccuaccugggcgccgaggcccugcugcaggcccuggagagaaacgacaccauccuggagguguggcugagaggcaacaccuucagccuggaggagguggacaagcugggcugcagagacaccagacugcugcuguga

SEQ ID NO: 9164 - RNA, 3123 nt, Artificial Sequence
  derived and/or modified sequence opt5 from NOD2__Homo_sapiens__AAG33677
augggcgaggaagggggaagcgccucccacgacgaggaagagagagcuucugugcugcucggccauagccccgggugcgaaauguguucccaggaggccuuccaagcgcagcggucucagcuggucgagcuucugguuagcggaucccucgaaggcuuugagucugugcuggauuggcuucugagcugggaagugcucuccugggaggacuacgagggguuccaucugcugggacagccucucagccaccuggcucgcagacuucuggauaccgucuggaacaagggcacaugggccugccaaaaacucaucgccgcugcccaggaagcucaggccgacucucaguccccgaagcugcacggcuguugggauccccauagccuucacccugcgcgggaccugcaaucucaccgccccgccauugugagacggcuccauucccacguugagaauaugcuggaucuggcuugggaacgcggguuugugagccaguaugagugcgacgaaaucagacucccuauuuucacgcccucucagcgggcccgcagacugcuugaucuggcuaccgucaaagccaacggacucgcggccuuucugcuucagcaugugcaagagcugccuguuccgcucgcucugccccuggaggccgcuacauguaagaaauacauggccaagcuccggaccacaguguccgcccagagccgcuuccuguccaccuaugacggcgcugaaacacuuugccuggaggauaucuacaccgaaaauguccucgaggugugggcggacguggggauggccggaccuccccagaagucuccugcuacgcugggccuugaggaacuguuuagcacccccgggcaccucaacgaugacgccgacacaguccugguugugggagaggccggcuccggcaaaagcacccugcuccaaagacugcaccuucugugggcugccgggcaggauuuccaggaauuucucuucguguuuccguucucuugucggcagcugcaaugcauggcgaagccucuguccguccgcacacuucucuuugagcauuguugcuggcccgacgugggacaggaagauauuuuccagcugcugcucgaccacccugauagaguucugcuuaccuucgacggcuuugaugaguucaaauuucgguucacggacagagaacgccauuguagccccacagaucccaccucugugcagacacugcucuuuaaucugcugcaagggaaccuucucaagaaugcucggaaagucgugaccagcagaccugccgccguuuccgcuuuccugcgcaaguauauccggaccgaguuuaaccugaagggauucucugagcagggcaucgaacucuaccugagaaaacgccaccaugagccggggguggccgaccggcuuauuagacugcuccaggaaacaagcgcucugcacggacugugccaccuucccgucuuuuccuggauggugagcaagugccaucaggagcuccugcugcaagagggcggcucuccuaaaacgaccacagauauguaucuccugauccuucagcacuuccugcuccaugccacacccccugacuccgcgagccaggggcugggacccucucugcuucgcggccggcucccgacccugcugcaccucgggagacuggcccuuuggggacugggcauguguugcuacgucuuuuccgcucagcaacuccaggccgcucaggugagcccugacgauauuucccugggguuccugguucgcgccaagggcgugguccccggaucuaccgcgccucuugaauuucugcacaucacguuccaauguuucuuugccgcuuucuaccucgcccugagcgcugacgugcccccugcccuccugcggcaucuuuuuaauugcggcagacccgggaacuccccgauggcccggcugcucccuacaauguguauucaggcuucugagggaaaagauagcuccguugcggcccugcugcagaaggcugaaccccacaaucuucagaucaccgccgccuuccuggcuggccuccugagccgcgagcauugggggcuccuggccgaaugccaaaccucugagaaagcgcuucugagacggcaggcuugugccagauggugccucgcccgcucccugcggaagcacuuucauagcauucccccugcugccccgggagaggcgaagucugugcacgcuaugcccggcuucaucuggcugaucagaucccuuuaugaaaugcaggaggaacgccuggccagaaaagccgcucgggggcucaacgucggccaccugaagcucacauuuuguagcgugggaccuaccgagugcgccgcucuggccuucgugcuucagcaucugcgcagacccguugcgcugcaacucgacuacaauucugucggcgauauugggguggaacagcugcuuccuugucugggagugugcaaagcccucuaucugcgggacaacaauaucagcgaucgcggcauuugcaagcucaucgagugugcucugcacugcgagcagcuucagaaacuggcccuguuuaacaacaagcucacagacgggugugcucauuccauggccaagcugcuugccugcagacaaaauuuccuggcucuccggcugggaaacaauuacauuacggcggccggcgcucagguccucgccgaagggcugcgcggcaacaccagccuucaguuucugggauucuggggcaauagagugggggaugagggagcccaagcucuggccgaagcgcucggcgaccaccagucucugcgguggcuuucccugguugggaacaauaucggaagcgugggcgcucaggcccucgcccugaugcucgcuaaaaacgucaugcuggaggaacuuugucuggaggagaaucaucugcaggaugaaggggugugcucccucgccgagggccugaagaaaaacucuagccuuaagauccugaaacucuccaauaacuguauuacauaucugggagcggaagcucugcuccaagcccuugagcgcaaugacaccauccuggagguuuggcugagaggcaacacauuuucucucgaagagguggauaagcuggggugccgggacaccagacuucugcucuga

SEQ ID NO: 9165 - protein, 1065 aa, Artificial Sequence
  NOD3__Homo_sapiens__C3VPR7
MRKQEVRTGREAGQGHGTGSPAEQVKALMDLLAGKGSQGSQAPQALDRTPDAPLGPCSNDSRIQRHRKALLSKVGGGPELGGPWHRLASLLLVEGLTDLQLREHDFTQVEATRGGGHPARTVALDRLFLPLSRVSVPPRVSITIGVAGMGKTTLVRHFVRLWAHGQVGKDFSLVLPLTFRDLNTHEKLCADRLICSVFPHVGEPSLAVAVPARALLILDGLDECRTPLDFSNTVACTDPKKEIPVDHLITNIIRGNLFPEVSIWITSRPSASGQIPGGLVDRMTEIRGFNEEEIKVCLEQMFPEDQALLGWMLSQVQADRALYLMCTVPAFCRLTGMALGHLWRSRTGPQDAELWPPRTLCELYSWYFRMALSGEGQEKGKASPRIEQVAHGGRKMVGTLGRLAFHGLLKKKYVFYEQDMKAFGVDLALLQGAPCSCFLQREETLASSVAYCFTHLSLQEFVAAAYYYGASRRAIFDLFTESGVSWPRLGFLTHFRSAAQRAMQAEDGRLDVFLRFLSGLLSPRVNALLAGSLLAQGEHQAYRTQVAELLQGCLRPDAAVCARAINVLHCLHELQHTELARSVEEAMESGALARLTGPAHRAALAYLLQVSDACAQEANLSLSLSQGVLQSLLPQLLYCRKLRLDTNQFQDPVMELLGSVLSGKDCRIQKISLAENQISNKGAKALARSLLVNRSLTSLDLRGNSIGPQGAKALADALKINRTLTSLSLQGNTVRDDGARSMAEALASNRTLSMLHLQKNSIGPMGAQRMADALKQNRSLKELMFSSNSIGDGGAKALAEALKVNQGLESLDLQSNSISDAGVAALMGALCTNQTLLSLSLRENSISPEGAQAIAHALCANSTLKNLDLTANLLHDQGARAIAVAVRENRTLTSLHLQWNFIQAGAAQALGQALQLNRSLTSLDLQENAIGDDGACAVARALKVNTALTALYLQVASIGASGAQVLGEALAVNRTLEILDLRGNAIGVAGAKALANALKVNSSLRRLNLQENSLGMDGAICIATALSGNHRLQHINLQGNHIGDSGARMISEAIKTNAPTCTVEM

SEQ ID NO: 9166 - RNA, 3198 nt, Artificial Sequence
  NOD3__Homo_sapiens__ACP40993
augaggaagcaagaggugcggacgggcagggaggccggccagggccacgguacgggcuccccagccgagcaggugaaagcccucauggaucugcuggcugggaagggcagucaaggcucccaggccccgcaggcccuggauaggacaccggaugccccgcuggggcccugcagcaaugacucaaggauacagaggcaccgcaaggcccugcugagcaaggugggagguggcccggagcugggcggacccuggcacaggcuggccucccuccugcugguggagggccugacggaccugcagcugagggaacacgacuucacacagguggaggccacccgcgggggcgggcaccccgccaggaccgucgcccuggaccggcucuuccugccucucucccgggugucugucccaccccgggucuccaucacuaucgggguggccggcaugggcaagaccacccuggugaggcacuucguccgccucugggcccaugggcaggucggcaaggacuucucgcuggugcugccucugaccuuccgggaucucaacacccacgagaagcugugugccgaccgacucaucugcucggucuucccgcacgucggggagcccagccuggcgguggcagucccagccagggcccuccugauccuggacggcuuggaugagugcaggacgccucuggacuucuccaacaccguggccugcacggacccaaagaaggagaucccgguggaccaccugaucaccaacaucauccguggcaaccucuuuccggaaguuuccaucuggaucaccucccgucccagugcaucuggccagaucccagggggccugguggaccggaugacggagauccggggcuuuaacgaggaggagaucaagguguguuuggagcagauguuccccgaggaccaggcccuucugggcuggaugcugagccaagugcaggcugacagggcccuguaccugaugugcaccgucccagccuucugcaggcucacggggauggcgcuaggccaccuguggcgcagcaggacggggccccaggaugcagagcuguggcccccgaggacccugugcgagcucuacucaugguacuuuaggauggcccucagcggggaggggcaggagaagggcaaggcaagcccucgcaucgagcagguggcccaugguggccgcaagaugguggggacauugggccgucuggccuuccaugggcugcucaagaagaaauacguguuuuacgagcaagacaugaaggcguuugguguagaccucgcucugcugcagggcgccccgugcagcugcuuccugcagagagaggagacguuggcaucgucaguggccuacugcuucacccaccugucccugcaggaguuuguggcagccgcguauuacuauggcgcauccaggagggccaucuucgaccucuucacugagagcggcguauccuggcccaggcugggcuuccucacgcauuucaggagcgcagcccagcgggccaugcaggcagaggacgggaggcuggacguguuccugcgcuuccucuccggccucuugucuccgagggucaaugcccuccuggccggcucccugcuggcccaaggcgagcaccaggccuaccggacccagguggcugagcuccugcagggcugccugcgccccgaugccgcagucugugcacgggccaucaacguguugcacugccugcaugagcugcagcacaccgagcuggcccgcagcguggaggaggccauggagagcggggcccuggccaggcugacuggucccgcgcaccgcgcugcccuggccuaccuccugcagguguccgacgccugugcccaggaggccaaccugucccugagccucagccagggcguccuucagagccugcugccccagcugcucuacugccggaagcucaggcuggacaccaaccaguuccaggaccccgugauggagcugcugggcagcgugcugagugggaaggacugucgcauucagaagaucagcuuggcggagaaccagaucaguaacaaaggggccaaagcucuggccagaucccucuuggucaacagaagucugaccucucuggaccuccgcgguaacuccauuggaccacaaggggccaaggcgcuggcagacgcuuugaagaucaaccgcacccugaccucccugagccuccagggcaacaccguuagggaugauggugccagguccauggcugaggccuuggccuccaaccggacccucuccaugcugcaccugcagaagaacagcaucgggcccaugggagcccagcggauggcagaugccuugaagcagaacaggagucugaaagagcucauguucuccaguaauaguauuggugauggaggugccaaggcccuggcugaggcccugaaggugaaccagggccuggagagccuggaccugcagagcaauuccaucagugacgcaggaguggcagcacugaugggggcccucugcaccaaccagacccuccucagccucagccuucgagaaaacuccaucagucccgagggagcccaggccaucgcucaugcccucugcgccaacagcacccugaagaaccuggaccugacagccaaccuccuccacgaccagggugcccgggccaucgcaguggcagugagagaaaaccgcacccucaccucccuucaccugcaguggaacuucauccaggccggcgcugcccaggcccugggacaagcacuacagcucaacaggagccucaccagcuuagauuuacaggagaacgccaucggggaugacggagcgugugcgguggcccgugcacugaaggucaacacagcccucacugcucucuaucuccagguggccucaauuggugcuucaggcgcccaggugcuaggggaagccuuggcugugaacagaaccuuggagauucucgacuuaagaggaaaugccauugggguggcuggagccaaagcccuggcaaaugcucugaagguaaacucaagucuccggagacucaaucuucaagagaauucucuggggauggacggggcgauaugcauugccacagcacugucuggaaaccacaggcuccagcauaucaaucuccagggaaaccacauuggggacuccggggccaggaugaucucagaggccaucaagacaaaugcucccacgugcacuguugaaauguga

SEQ ID NO: 9167 - RNA, 3198 nt, Artificial Sequence
  derived and/or modified sequence opt1 from NOD3__Homo_sapiens__ACP40993
augcgcaagcaggaggugcggaccggccgcgaggccgggcagggccacgggaccggcagccccgccgagcaggucaaggcgcugauggaccuccuggccgggaagggcucccagggcagccaggccccgcaggcccuggaccggacccccgacgcgccccucgggcccugcuccaacgacagccgcauccagcggcaccgcaaggcccugcuguccaaggugggcgggggcccggagcucgggggccccuggcaccggcuggccagccugcuccugguggagggccugaccgaccuccagcugcgcgagcacgacuucacccaggucgaggccacccgcgggggcgggcaccccgcccggacgguggcgcuggaccggcuguuccugccccugucccgcgugagcgucccgccccggguguccaucaccaucggcguggccggcauggggaagaccacccucguccgccacuucgugcggcugugggcccacggccagguggggaaggacuucagccugguccucccccugacguuccgcgaccugaacacccacgagaagcucugcgccgaccggcugaucugcuccguguucccccacgugggcgagccgagccuggccgucgcggugcccgcccgcgcccuccugauccuggacgggcucgacgagugccggacgccccuggacuucuccaacaccguggccugcaccgaccccaagaaggagaucccggucgaccaccugaucaccaacaucauccgcggcaaccucuuccccgaggugagcaucuggaucaccucccggcccagcgccuccggccagauccccgggggccugguggaccgcaugaccgagauccgcggguucaacgaggaggagaucaaggucugccuggagcagauguucccggaggaccaggcgcuccugggcuggaugcugagccaggugcaggccgaccgggcccucuaccugaugugcacggugcccgccuucugccgccugaccgggauggcccucggccaccuguggcggucccgcaccggcccccaggacgcggagcuguggcccccgcggacccucugcgagcuguacagcugguacuuccgcauggcccugagcggggagggccaggagaaggggaaggccagcccccggaucgagcaggucgcccacggcgggcgcaagauggugggcacgcucggccggcuggccuuccacgggcugcugaagaagaaguacgucuucuacgagcaggacaugaaggcguucggcguggaccucgcccugcugcagggggcccccugcuccugcuuccuccagcgcgaggagacccuggccuccagcguggcguacugcuucacccaccugucccuccaggaguucgucgccgccgccuacuacuacggcgccagccggcgcgcgaucuucgaccuguucaccgaguccggcgugagcuggccccggcugggguuccucacgcacuuccgcuccgccgcccagcgggccaugcaggccgaggacggccgccuggacguguuccugcgguuccucagcgggcugcuguccccgcgcgucaacgcgcuccuggccggcagccugcucgcccagggggagcaccaggccuaccggacccagguggccgagcugcugcagggcugccuccgccccgacgcggccgugugcgcccgcgccaucaacguccugcacugccugcacgagcuccagcacaccgagcuggcgcgguccguggaggaggccauggagagcggcgcccuggcccgccucaccgggcccgcccaccgggcggcccuggccuaccugcuccagguguccgacgccugcgcccaggaggcgaaccugagccugucccucagccagggcguccugcagucccugcucccgcagcugcuguacugccgcaagcuccggcuggacacgaaccaguuccaggaccccgugauggagcugcucgggagcgugcugagcggcaaggacugccgcauccagaagaucucccuggccgagaaccagaucagcaacaagggggccaaggcccucgcccggucccugcuggucaaccgcagccucaccucccuggaccugcggggcaacagcaucggcccccagggggcgaaggcccucgccgacgcccugaagaucaaccgcacccugaccucccucagccugcagggcaacacggugcgggacgacggggcgcgcuccauggccgaggcccuggccagcaaccggacccucuccaugcugcaccuccagaagaacagcaucggccccaugggggcccagcgcauggcggacgcccucaagcagaaccggucccugaaggagcugauguucagcuccaacagcaucggcgacggcggggccaaggcccucgccgaggcgcugaaggugaaccagggccuggagucccucgaccugcagagcaacagcaucuccgacgccggggucgccgcccugaugggcgcccucugcaccaaccagacccugcugagccucucccugcgcgagaacagcaucuccccggagggggcgcaggccaucgcccacgcccugugcgccaacagcacgcucaagaaccuggaccugaccgcgaaccuccugcacgaccagggcgcccgggccaucgccguggcggugcgcgagaaccggacccugaccucccuccaccuccaguggaacuucauccaggccggcgccgcccaggcccuggggcaggcgcugcagcugaaccgcagccugaccucccucgaccugcaggagaacgccaucggcgacgacggggccugcgccgucgcccgggcgcugaaggugaacacggcccucaccgcccuguaccuccagguggccagcaucggcgccuccggcgcgcagguccugggggaggcccuggccgugaaccgcacccuggagauccuggaccuccgcggcaacgccaucgggguggcgggcgccaaggcccuggccaacgcccugaaggucaacagcucccuccggcgccugaaccugcaggagaacagccucgggauggacggcgcgaucugcaucgccaccgcccuguccggcaaccaccggcugcagcacaucaaccuccaggggaaccacaucggcgacagcggggcccgcaugaucuccgaggccaucaagacgaacgcgcccacgugcaccguggagauguga

SEQ ID NO: 9168 - RNA, 3198 nt, Artificial Sequence
  derived and/or modified sequence opt2 from NOD3__Homo_sapiens__ACP40993
augcgcaagcaggagguccgcaccggccgcgaggccggccagggccacggcaccggcucccccgccgagcaggucaaggcccucauggaccuccucgccggcaagggcucccagggcucccaggccccccaggcccucgaccgcacccccgacgccccccucggccccugcuccaacgacucccgcauccagcgccaccgcaaggcccuccucuccaaggucggcggcggccccgagcucggcggccccuggcaccgccucgccucccuccuccucgucgagggccucaccgaccuccagcuccgcgagcacgacuucacccaggucgaggccacccgcggcggcggccaccccgcccgcaccgucgcccucgaccgccucuuccucccccucucccgcgucuccguccccccccgcgucuccaucaccaucggcgucgccggcaugggcaagaccacccucguccgccacuucguccgccucugggcccacggccaggucggcaaggacuucucccucguccucccccucaccuuccgcgaccucaacacccacgagaagcucugcgccgaccgccucaucugcuccgucuucccccacgucggcgagcccucccucgccgucgccguccccgcccgcgcccuccucauccucgacggccucgacgagugccgcaccccccucgacuucuccaacaccgucgccugcaccgaccccaagaaggagauccccgucgaccaccucaucaccaacaucauccgcggcaaccucuuccccgaggucuccaucuggaucaccucccgccccuccgccuccggccagauccccggcggccucgucgaccgcaugaccgagauccgcggcuucaacgaggaggagaucaaggucugccucgagcagauguuccccgaggaccaggcccuccucggcuggaugcucucccagguccaggccgaccgcgcccucuaccucaugugcaccguccccgccuucugccgccucaccggcauggcccucggccaccucuggcgcucccgcaccggcccccaggacgccgagcucuggcccccccgcacccucugcgagcucuacuccugguacuuccgcauggcccucuccggcgagggccaggagaagggcaaggccuccccccgcaucgagcaggucgcccacggcggccgcaagauggucggcacccucggccgccucgccuuccacggccuccucaagaagaaguacgucuucuacgagcaggacaugaaggccuucggcgucgaccucgcccuccuccagggcgcccccugcuccugcuuccuccagcgcgaggagacccucgccuccuccgucgccuacugcuucacccaccucucccuccaggaguucgucgccgccgccuacuacuacggcgccucccgccgcgccaucuucgaccucuucaccgaguccggcgucuccuggccccgccucggcuuccucacccacuuccgcuccgccgcccagcgcgccaugcaggccgaggacggccgccucgacgucuuccuccgcuuccucuccggccuccucuccccccgcgucaacgcccuccucgccggcucccuccucgcccagggcgagcaccaggccuaccgcacccaggucgccgagcuccuccagggcugccuccgccccgacgccgccgucugcgcccgcgccaucaacguccuccacugccuccacgagcuccagcacaccgagcucgcccgcuccgucgaggaggccauggaguccggcgcccucgcccgccucaccggccccgcccaccgcgccgcccucgccuaccuccuccaggucuccgacgccugcgcccaggaggccaaccucucccucucccucucccagggcguccuccagucccuccucccccagcuccucuacugccgcaagcuccgccucgacaccaaccaguuccaggaccccgucauggagcuccucggcuccguccucuccggcaaggacugccgcauccagaagaucucccucgccgagaaccagaucuccaacaagggcgccaaggcccucgcccgcucccuccucgucaaccgcucccucaccucccucgaccuccgcggcaacuccaucggcccccagggcgccaaggcccucgccgacgcccucaagaucaaccgcacccucaccucccucucccuccagggcaacaccguccgcgacgacggcgcccgcuccauggccgaggcccucgccuccaaccgcacccucuccaugcuccaccuccagaagaacuccaucggccccaugggcgcccagcgcauggccgacgcccucaagcagaaccgcucccucaaggagcucauguucuccuccaacuccaucggcgacggcggcgccaaggcccucgccgaggcccucaaggucaaccagggccucgagucccucgaccuccaguccaacuccaucuccgacgccggcgucgccgcccucaugggcgcccucugcaccaaccagacccuccucucccucucccuccgcgagaacuccaucucccccgagggcgcccaggccaucgcccacgcccucugcgccaacuccacccucaagaaccucgaccucaccgccaaccuccuccacgaccagggcgcccgcgccaucgccgucgccguccgcgagaaccgcacccucaccucccuccaccuccaguggaacuucauccaggccggcgccgcccaggcccucggccaggcccuccagcucaaccgcucccucaccucccucgaccuccaggagaacgccaucggcgacgacggcgccugcgccgucgcccgcgcccucaaggucaacaccgcccucaccgcccucuaccuccaggucgccuccaucggcgccuccggcgcccagguccucggcgaggcccucgccgucaaccgcacccucgagauccucgaccuccgcggcaacgccaucggcgucgccggcgccaaggcccucgccaacgcccucaaggucaacuccucccuccgccgccucaaccuccaggagaacucccucggcauggacggcgccaucugcaucgccaccgcccucuccggcaaccaccgccuccagcacaucaaccuccagggcaaccacaucggcgacuccggcgcccgcaugaucuccgaggccaucaagaccaacgcccccaccugcaccgucgagauguga

SEQ ID NO: 9169 - RNA, 3198 nt, Artificial Sequence
  derived and/or modified sequence opt3 from NOD3__Homo_sapiens__ACP40993
augagaaagcaggaggugaggaccggccgggaagccgggcaaggacacgguacaggcagccccgcugagcaggucaaagcacugauggaccuccuugccgggaagggaucccagggcucucaggcgccucaagcucuggaucgcacuccagacgccccguugggucccugcucaaacgauagucgaauccagcgucauagaaaagcauuacugagcaagguugggggaggcccugaacuaggcgggccauggcacaggcucgccucccugcuucugguggagggauugacggaccuccagcugcgggaacaugauuucacccagguagaggcuacacgcgguggcgggcaccccgcaagaacuguggcccuggacaggcucuuuuuaccucugucucgggucucggugccaccccgcguuucaauuaccauaggaguggcuggcauggguaaaacaacccuuguccgacauuucgugagauugugggcccacgggcaaguaggaaaggauuuuagccugguucuaccucucacuuucagggaccugaauacacacgagaaacuuugugcggaucggcugaucugcaguguguuuccacaugucggcgaaccguccuuggcaguggccgugcccgcucgugcccuccugauuuuagacggccuggaugagugucgcaccccucucgacuucucuaacacggucgcaugcacugaucccaaaaaggaaaucccaguugaccaccuuauuaccaauaucauaagagggaaccuguuuccugaggugagcaucuggauuacauccaggccaucagcuaguggacagauccccgguggcuugguagaccggaugacugagauucgaggguucaaugaagaggaaaucaaagugugucuagagcagauguuuccggaagaucaggcccugcucggauggaugcugagccaaguccaggcggaccgcgcccuuuaccugaugugcaccgugccugcauucuguagauugacaggcauggcucucggucaucuguggaggucucggaccgggccccaggaugccgaguuauggccaccucgcacgcugugcgagcuauauuccugguacuuuagaauggcucucucaggcgaaggacaagagaagggcaaagccagccccaggauagaacagguugcacacgggggacguaagaugguggguacucugggccggcuugccuuccacggguugcugaagaaaaaguaugucuuuuacgagcaggacaugaaggcuuucggaguggaucucgcgcugcuucagggcgcaccauguaguugcuuccugcaacgagaagagacauuggccucuuccguagcuuauuguuuuacccaucucagccugcaggaguucguugccgcagccuacuauuacggugcuucgagaagggccauuuuugacuuauucacugaaucugggguguccuggccccgccugggcuuucuaacacacuuccggucagcagcgcagagagcuaugcaggccgaggauggaaggcucgacgucuuucugcgcuuccuuaguggcuugcugagcccucgagugaacgcacuccuggccggguccuuacuggcucaaggagaacaucaggccuaccggacccaggucgcagagcuuuugcaggguugccuccguccagaugcugccgugugcgcgagagccaucaauguucugcacugucuacaugaacugcaacacacggagcucgcuaggucuguggaggaagcaauggagagcggcgcccuggcucgccuuaccgggccggcccaccgggcagcguuggccuaucuguuacagguaucagacgcuugcgcccaggaagcaaaccucagucugucccuuagccagggaguccugcaaucuuugcucccccagcugcuauacuguagaaagcugaggcucgauacaaaucaguuucaagacccugugauggagcugcuuggcucaguuuugagugguaaagacugccgcauucagaagaucagccuggcugagaaccagaucuccaauaaaggggccaaggcauuagcccgaucucuccuggugaaccggucgcuuacuagccuggaucuaagaggcaauuccauuggaccacagggcgcuaaggcgcucgccgacgcacugaaaauaaacaggaccuugacaucacugaguuuacaagggaauacuguccgugaugacggagcucgcucuauggccgaagcccucgcuagcaaccggacccuguccaugcuucaucugcagaagaacucaaucggccccaugggugcacagagaauggccgaugcguugaaacagaauaggagccucaaggagcugauguucucuuccaacaguauuggggacggaggcgcuaaagcccuagcagaagcccugaaggugaaucaaggucuugagagccucgaucugcagucuaacuccaucucagacgcuggcguagcagccuugaugggggcgcuguguacaaaucagaccuuacucagucugagccuucgagaaaacucgauauccccugagggagcucaggccauugcacacgcccugugcgcuaauucuacuuugaagaaccucgaucugacggccaaucuacugcaugaccaaggcgcacgggcuaucgccguggcgguucgcgagaacagaacacuuaccagccuccaucugcaguggaauuuuauccaggccggggcagcucaagccuugggacaggcuuuacagcugaacaggucacucacuucacuggaucuucaggaaaaugcaauuggcgacgauggugccugugccgucgcucgggcgcugaaagugaacaccgcauugacagcccuauaucugcaaguggcuuccaucggggccucuggagcacagguccucggcgaggcccuggcuguuaaucgaacccuugaaauuuuagaccugagagguaacgcgauaggcguggccggggcaaaggcucucgccaacgcauugaaagugaauagcucccugcgcaggcucaaccugcaggagaauagucuuggaauggacggcgccaucugcauugcuacugcccugagcgggaaccaccguuugcagcacaucaaucuacaaggaaaccacaucggcgauaguggugcgcggaugauuucugaagcaauaaagacaaaugccccaacguguaccguagagauguga

SEQ ID NO: 9170 - RNA, 3198 nt, Artificial Sequence
  derived and/or modified sequence opt4 from NOD3__Homo_sapiens__ACP40993
augagaaagcaggaggugagaaccggcagagaggccggccagggccacggcaccggcagccccgccgagcaggugaaggcccugauggaccugcuggccggcaagggcagccagggcagccaggccccccaggcccuggacagaacccccgacgccccccugggccccugcagcaacgacagcagaauccagagacacagaaaggcccugcugagcaaggugggcggcggccccgagcugggcggccccuggcacagacuggccagccugcugcugguggagggccugaccgaccugcagcugagagagcacgacuucacccagguggaggccaccagaggcggcggccaccccgccagaaccguggcccuggacagacuguuccugccccugagcagagugagcgugccccccagagugagcaucaccaucggcguggccggcaugggcaagaccacccuggugagacacuucgugagacugugggcccacggccaggugggcaaggacuucagccuggugcugccccugaccuucagagaccugaacacccacgagaagcugugcgccgacagacugaucugcagcguguucccccacgugggcgagcccagccuggccguggccgugcccgccagagcccugcugauccuggacggccuggacgagugcagaaccccccuggacuucagcaacaccguggccugcaccgaccccaagaaggagauccccguggaccaccugaucaccaacaucaucagaggcaaccuguuccccgaggugagcaucuggaucaccagcagacccagcgccagcggccagauccccggcggccugguggacagaaugaccgagaucagaggcuucaacgaggaggagaucaaggugugccuggagcagauguuccccgaggaccaggcccugcugggcuggaugcugagccaggugcaggccgacagagcccuguaccugaugugcaccgugcccgccuucugcagacugaccggcauggcccugggccaccuguggagaagcagaaccggcccccaggacgccgagcuguggccccccagaacccugugcgagcuguacagcugguacuucagaauggcccugagcggcgagggccaggagaagggcaaggccagccccagaaucgagcagguggcccacggcggcagaaagauggugggcacccugggcagacuggccuuccacggccugcugaagaagaaguacguguucuacgagcaggacaugaaggccuucggcguggaccuggcccugcugcagggcgcccccugcagcugcuuccugcagagagaggagacccuggccagcagcguggccuacugcuucacccaccugagccugcaggaguucguggccgccgccuacuacuacggcgccagcagaagagccaucuucgaccuguucaccgagagcggcgugagcuggcccagacugggcuuccugacccacuucagaagcgccgcccagagagccaugcaggccgaggacggcagacuggacguguuccugagauuccugagcggccugcugagccccagagugaacgcccugcuggccggcagccugcuggcccagggcgagcaccaggccuacagaacccagguggccgagcugcugcagggcugccugagacccgacgccgccgugugcgccagagccaucaacgugcugcacugccugcacgagcugcagcacaccgagcuggccagaagcguggaggaggccauggagagcggcgcccuggccagacugaccggccccgcccacagagccgcccuggccuaccugcugcaggugagcgacgccugcgcccaggaggccaaccugagccugagccugagccagggcgugcugcagagccugcugccccagcugcuguacugcagaaagcugagacuggacaccaaccaguuccaggaccccgugauggagcugcugggcagcgugcugagcggcaaggacugcagaauccagaagaucagccuggccgagaaccagaucagcaacaagggcgccaaggcccuggccagaagccugcuggugaacagaagccugaccagccuggaccugagaggcaacagcaucggcccccagggcgccaaggcccuggccgacgcccugaagaucaacagaacccugaccagccugagccugcagggcaacaccgugagagacgacggcgccagaagcauggccgaggcccuggccagcaacagaacccugagcaugcugcaccugcagaagaacagcaucggccccaugggcgcccagagaauggccgacgcccugaagcagaacagaagccugaaggagcugauguucagcagcaacagcaucggcgacggcggcgccaaggcccuggccgaggcccugaaggugaaccagggccuggagagccuggaccugcagagcaacagcaucagcgacgccggcguggccgcccugaugggcgcccugugcaccaaccagacccugcugagccugagccugagagagaacagcaucagccccgagggcgcccaggccaucgcccacgcccugugcgccaacagcacccugaagaaccuggaccugaccgccaaccugcugcacgaccagggcgccagagccaucgccguggccgugagagagaacagaacccugaccagccugcaccugcaguggaacuucauccaggccggcgccgcccaggcccugggccaggcccugcagcugaacagaagccugaccagccuggaccugcaggagaacgccaucggcgacgacggcgccugcgccguggccagagcccugaaggugaacaccgcccugaccgcccuguaccugcagguggccagcaucggcgccagcggcgcccaggugcugggcgaggcccuggccgugaacagaacccuggagauccuggaccugagaggcaacgccaucggcguggccggcgccaaggcccuggccaacgcccugaaggugaacagcagccugagaagacugaaccugcaggagaacagccugggcauggacggcgccaucugcaucgccaccgcccugagcggcaaccacagacugcagcacaucaaccugcagggcaaccacaucggcgacagcggcgccagaaugaucagcgaggccaucaagaccaacgcccccaccugcaccguggagauguga

SEQ ID NO: 9171 - RNA, 3198 nt, Artificial Sequence
  derived and/or modified sequence opt5 from NOD3__Homo_sapiens__ACP40993
augagaaagcaggaggugcggaccggccgcgaagccgggcaaggacacggcacagggagccccgcugagcaggucaaagcccugauggaccuccuggcgggaaagggcucccaggggucucaggcuccucaagcccuugauagaacgccggacgcuccccugggaccuugcagcaacgauucccggauccagcgccauagaaaagcccuccugucuaagguuggcggcgggcccgaacuuggaggcccuuggcaccggcuggccagccuccugcugguggaggggcucaccgaccugcagcuucgcgaacaugauuucacacagguggaggcuaccagaggaggcgggcaccccgcccggacagucgcgcuggaccgccucuuucugccucuuuccagagugucuguuccgccccgggugagcauuaccaucggagucgccggcaugggcaaaacaacccuggugcgccauuucguuagacucugggcucacgggcaagugggaaaggauuuuucccugguccugccucucacguuccgggaccugaauacccacgagaaacuuugugccgaucgccugauuugcagcguguuuccccaugugggcgaaccuucucucgcugucgccguucccgcgagagcccugcuuauccuggacgggcucgaugagugucggacaccgcuggacuucuccaacaccguggcuugcacagauccuaagaaggaaauucccguggaccaccugaucaccaauaucauuagaggaaaccucuuuccugaggucagcaucuggauuacgucucgccccuccgccagcggccagauccccgggggacugguggaccggaugacagagauuagaggcuucaaugaagaggaaaucaaaguuugucuugagcagauguuuccugaagaucaggcucugcucggcuggaugcugucucaagugcaggccgaccgcgcccuuuaccugaugugcaccgucccggcuuucugucggcucacagggauggcgcugggacaucuguggagaucccgcaccggcccccaggaugccgagcucuggccuccccggacccugugcgagcuuuauagcugguacuuuagaauggcucuguccggggaaggacaagagaagggcaaagccucuccucgcauugaacagguggcccacgggggccggaagaugguuggaacacucggcagacuggcuuuccacgggcugcuuaagaaaaaguauguguuuuacgagcaggacaugaaagccuucggagucgaucucgcgcugcugcagggcgcucccuguagcugcuuccuccaacgcgaagagacgcuggccuccagcguggccuauuguuuuacccaucuuucucugcaggaguucgucgcugccgcuuacuauuacggggccucccggagagcgaucuuugaccucuucacagaaagcggagugucuuggccgcggcugggcuuucugacccacuuccgcagcgccgcucagagagccaugcaggcugaggaugggcggcuugacguuuuucucagauuccuguccggccugcucucuccucgcgugaacgcccugcuugcgggaagccugcucgcccaaggcgaacaucaggcuuaccggacacaggucgccgagcugcugcaggggugccuuagacccgaugcugccgugugcgcccgcgcuaucaauguucuccacugucugcaugaacugcaacacaccgagcucgcgagauccguggaggaagccauggagagcggagcucuggcccggcuuacgggcccugcccaccgcgcugcccuggcguaucuccugcaggucucugacgcuugcgcccaggaagccaaccugucccuuagccucucucagggggugcugcaaucccugcucccccagcugcuuuacuguagaaagcugcggcucgauacaaaucaguuucaagacccugugauggagcugcugggaagcguucuuuccggcaaagacugccgcauucagaagaucucucuggcugagaaccagauuagcaauaaaggggccaaggcgcucgcuagaucccugcucgucaaccggucucugaccagccuugaucugcgcggcaauuccaucggaccccagggcgccaaggcccucgcugacgcccugaaaauuaacagaacccugacaagccuuucucugcaagggaauaccgugcgggaugacggagcucgcuccauggccgaagcgcucgccagcaacagaacacugucuaugcuccaucugcagaagaacuccaucggcccgaugggggcucagcggauggccgaugcucuuaaacagaauagaagccugaaggagcucauguucucuagcaacuccaucggagacggcggggccaaagcccuggcugaagcgcugaaggugaaucaaggccuugagagccuggaucuccagucuaacuccauuagcgacgccggagucgcugcccugaugggcgcccucuguacgaaucagacccugcuuucccugucucugcgcgaaaacagcaucuccccugagggggcucaggccauugcgcacgcucucugcgccaauucuacacugaagaaccuugaucugaccgccaaucuccugcaugaccaaggagcucgggccaucgcgguggcuguuagagagaaccgcacacucaccagccugcaccuucaguggaauuuuauucaggccggcgccgcucaagcccuggggcaggcucugcagcucaaccggucccugacgucucuugaucugcaggaaaaugccaucggagacgauggcgcgugugccguggcuagagcccucaaagucaacaccgcucugacagcccucuaucugcaaguggccagcaucggcgcuuccggggcgcagguucuuggagaggcccuggcugugaaucgcacccuggaaauucucgaccugcggggcaacgccaucggggucgccggagcuaaggcccuugcgaacgcucugaaagugaauagcucucucagacgccugaaccuccaggaaaauucccugggcauggacggggccauuugcaucgccacagcucuuagcggaaaccaccggcugcagcauauuaaucugcaaggcaaccacaucggcgauucuggggccagaaugauuuccgaggcgaucaagaccaaugcccccacguguacaguugagauguga

SEQ ID NO: 9172 - protein, 1112 aa, Artificial Sequence
  NOD3__Homo_sapiens__H3BLT9
MEMDAPRPPSLAVPGAASRPGRLLDGGHGRQQVQALSSQLLEVIPDSMRKQEVRTGREAGQGHGTGSPAEQVKALMDLLAGKGSQGSQAPQALDRTPDAPLGPCSNDSRIQRHRKALLSKVGGGPELGGPWHRLASLLLVEGLTDLQLREHDFTQVEATRGGGHPARTVALDRLFLPLSRVSVPPRVSITIGVAGMGKTTLVRHFVRLWAHGQVGKDFSLVLPLTFRDLNTHEKLCADRLICSVFPHVGEPSLAVAVPARALLILDGLDECRTPLDFSNTVACTDPKKEIPVDHLITNIIRGNLFPEVSIWITSRPSASGQIPGGLVDRMTEIRGFNEEEIKVCLEQMFPEDQALLGWMLSQVQADRALYLMCTVPAFCRLTGMALGHLWRSRTGPQDAELWPPRTLCELYSWYFRMALSGEGQEKGKASPRIEQVAHGGRKMVGTLGRLAFHGLLKKKYVFYEQDMKAFGVDLALLQGAPCSCFLQREETLASSVAYCFTHLSLQEFVAAAYYYGASRRAIFDLFTESGVSWPRLGFLTHFRSAAQRAMQAEDGRLDVFLRFLSGLLSPRVNALLAGSLLAQGEHQAYRTQVAELLQGCLRPDAAVCARAINVLHCLHELQHTELARSVEEAMESGALARLTGPAHRAALAYLLQVSDACAQEANLSLSLSQGVLQSLLPQLLYCRKLRLDTNQFQDPVMELLGSVLSGKDCRIQKISLAENQISNKGAKALARSLLVNRSLTSLDLRGNSIGPQGAKALADALKINRTLTSLSLQGNTVRDDGARSMAEALASNRTLSMLHLQKNSIGPMGAQRMADALKQNRSLKELMFSSNSIGDGGAKALAEALKVNQGLESLDLQSNSISDAGVAALMGALCTNQTLLSLSLRENSISPEGAQAIAHALCANSTLKNLDLTANLLHDQGARAIAVAVRENRTLTSLHLQWNFIQAGAAQALGQALQLNRSLTSLDLQENAIGDDGACAVARALKVNTALTALYLQVASIGASGAQVLGEALAVNRTLEILDLRGNAIGVAGAKALANALKVNSSLRRLNLQENSLGMDGAICIATALSGNHRLQHINLQGNHIGDSGARMISEAIKTNAPTCTVEM

SEQ ID NO: 9173 - RNA, 3339 nt, Artificial Sequence
  NOD3__Homo_sapiens__EAW85351
auggagauggacgcccccaggccccccagucuugcugucccuggagcagcaucgaggcccgggaggcugcuggauggggggcacggcaggcagcagguucaggcccucucuucacagcuccuggaggugauccccgacuccaugaggaagcaagaggugcggacgggcagggaggccggccagggccacgguacgggcuccccagccgagcaggugaaagcccucauggaucugcuggcugggaagggcagucaaggcucccaggccccgcaggcccuggauaggacaccggaugccccgcuggggcccugcagcaaugacucaaggauacagaggcaccgcaaggcccugcugagcaaggugggagguggcccggagcugggcggacccuggcacaggcuggccucccuccugcugguggagggccugacggaccugcagcugagggaacacgacuucacacagguggaggccacccgcgggggcgggcaccccgccaggaccgucgcccuggaccggcucuuccugccucucucccgggugucugucccaccccgggucuccaucacuaucgggguggccggcaugggcaagaccacccuggugaggcacuucguccgccucugggcccaugggcaggucggcaaggacuucucgcuggugcugccucugaccuuccgggaucucaacacccacgagaagcugugugccgaccgacucaucugcucggucuucccgcacgucggggagcccagccuggcgguggcagucccagccagggcccuccugauccuggacggcuuggaugagugcaggacgccucuggacuucuccaacaccguggccugcacggacccaaagaaggagaucccgguggaccaccugaucaccaacaucauccguggcaaccucuuuccggaaguuuccaucuggaucaccucccgucccagugcaucuggccagaucccagggggccugguggaccggaugacggagauccggggcuuuaacgaggaggagaucaagguguguuuggagcagauguuccccgaggaccaggcccuucugggcuggaugcugagccaagugcaggcugacagggcccuguaccugaugugcaccgucccagccuucugcaggcucacggggauggcgcuaggccaccuguggcgcagcaggacggggccccaggaugcagagcuguggcccccgaggacccugugcgagcucuacucaugguacuuuaggauggcccucagcggggaggggcaggagaagggcaaggcaagcccucgcaucgagcagguggcccaugguggccgcaagaugguggggacauugggccgucuggccuuccaugggcugcucaagaagaaauacguguuuuacgagcaagacaugaaggcguuugguguagaccucgcucugcugcagggcgccccgugcagcugcuuccugcagagagaggagacguuggcaucgucaguggccuacugcuucacccaccugucccugcaggaguuuguggcagccgcguauuacuauggcgcauccaggagggccaucuucgaccucuucacugagagcggcguauccuggcccaggcugggcuuccucacgcauuucaggagcgcagcccagcgggccaugcaggcagaggacgggaggcuggacguguuccugcgcuuccucuccggccucuugucuccgagggucaaugcccuccuggccggcucccugcuggcccaaggcgagcaccaggccuaccggacccagguggcugagcuccugcagggcugccugcgccccgaugccgcagucugugcacgggccaucaacguguugcacugccugcaugagcugcagcacaccgagcuggcccgcagcguggaggaggccauggagagcggggcccuggccaggcugacuggucccgcgcaccgcgcugcccuggccuaccuccugcagguguccgacgccugugcccaggaggccaaccugucccugagccucagccagggcguccuucagagccugcugccccagcugcucuacugccggaagcucaggcuggacaccaaccaguuccaggaccccgugauggagcugcugggcagcgugcugagugggaaggacugucgcauucagaagaucagcuuggcggagaaccagaucaguaacaaaggggccaaagcucuggccagaucccucuuggucaacagaagucugaccucucuggaccuccgcgguaacuccauuggaccacaaggggccaaggcgcuggcagacgcuuugaagaucaaccgcacccugaccucccugagccuccagggcaacaccguuagggaugauggugccagguccauggcugaggccuuggccuccaaccggacccucuccaugcugcaccugcagaagaacagcaucgggcccaugggagcccagcggauggcagaugccuugaagcagaacaggagucugaaagagcucauguucuccaguaauaguauuggugauggaggugccaaggcccuggcugaggcccugaaggugaaccagggccuggagagccuggaccugcagagcaauuccaucagugacgcaggaguggcagcacugaugggggcccucugcaccaaccagacccuccucagccucagccuucgagaaaacuccaucagucccgagggagcccaggccaucgcucaugcccucugcgccaacagcacccugaagaaccuggaccugacagccaaccuccuccacgaccagggugcccgggccaucgcaguggcagugagagaaaaccgcacccucaccucccuucaccugcaguggaacuucauccaggccggcgcugcccaggcccugggacaagcacuacagcucaacaggagccucaccagcuuagauuuacaggagaacgccaucggggaugacggagcgugugcgguggcccgugcacugaaggucaacacagcccucacugcucucuaucuccagguggccucaauuggugcuucaggcgcccaggugcuaggggaagccuuggcugugaacagaaccuuggagauucucgacuuaagaggaaaugccauugggguggcuggagccaaagcccuggcaaaugcucugaagguaaacucaagucuccggagacucaaucuucaagagaauucucuggggauggacggggcgauaugcauugccacagcacugucuggaaaccacaggcuccagcauaucaaucuccagggaaaccacauuggggacuccggggccaggaugaucucagaggccaucaagacaaaugcucccacgugcacuguugaaauguga

SEQ ID NO: 9174 - RNA, 3339 nt, Artificial Sequence
  derived and/or modified sequence opt1 from NOD3__Homo_sapiens__EAW85351
auggagauggacgcgccccgcccgcccagccuggccgugcccggcgccgccucccggcccgggcgccuccuggacggcgggcacggccggcagcagguccaggcccugagcucccagcuccuggaggugaucccggacagcaugcgcaagcaggaggugcggaccgggcgcgaggccggccagggccacgggaccggcucccccgccgagcaggucaaggcgcugauggaccuccuggccgggaagggcagccaggggucccaggcgccccaggcccuggaccggacccccgacgccccgcucggccccugcagcaacgacucccgcauccagcggcaccgcaaggcccugcugagcaaggugggcgggggccccgagcucgggggccccuggcaccggcuggccucccugcuccugguggagggccugaccgaccuccagcugcgcgagcacgacuucacccaggucgaggccacccgcgggggcgggcacccggcccggacgguggcgcuggaccggcuguuccugccccugagccgcguguccgucccgccccgggugagcaucaccaucggcguggccgggaugggcaagaccacccucguccgccacuucgugcggcugugggcccacggccagguggggaaggacuucucccugguccucccccugacguuccgcgaccugaacacccacgagaagcucugcgccgaccggcugaucugcagcguguucccccacgugggcgagcccucccuggccgucgcggugcccgcccgcgcccuccugauccuggacgggcucgacgagugccgcaccccgcuggacuucagcaacaccguggccugcacggaccccaagaaggagauccccgucgaccaccugaucaccaacaucauccggggcaaccucuuccccgagguguccaucuggaucaccagccgcccgagcgccuccgggcagauccccggcggccugguggaccggaugaccgagauccgcggguucaacgaggaggagaucaaggucugccuggagcagauguuccccgaggaccaggcgcuccugggcuggaugcugagccaggugcaggccgaccgggcccucuaccugaugugcacgguccccgccuucugccgccugaccgggauggcccucggccaccuguggcggucccgcaccgggccgcaggacgcggagcuguggccgccccggacccugugcgagcucuacagcugguacuuccgcauggcccuguccggcgagggccaggagaaggggaaggccagcccccggaucgagcaggucgcccacggcgggcgcaagauggugggcacgcugggccggcucgcguuccacgggcugcugaagaagaaguacguguucuacgagcaggacaugaaggccuucggcguggaccucgcccugcugcagggggcccccugcuccugcuuccuccagcgcgaggagacccuggccagcuccguggcguacugcuucacccaccugagccuccaggaguucgucgccgccgccuacuacuacggcgccucccggcgcgcgaucuucgaccuguucaccgagagcgggguguccuggccccggcugggcuuccucacgcacuuccgcagcgccgcccagcgggccaugcaggccgaggacggccgccuggacguguuccugcgcuuccucuccgggcugcugagcccccgggucaacgcgcuccuggccggcucccugcucgcccagggggagcaccaggccuaccgcacccagguggcggagcugcugcagggcugccuccggccggacgccgccgugugcgcccgcgccaucaacguccugcacugccugcacgagcuccagcacaccgagcuggcgcggagcguggaggaggccauggaguccggggcccuggcccgccucaccggccccgcccaccgggcggcccuggccuaccugcuccaggugagcgacgccugcgcccaggaggcgaaccugagccugucccucagccagggcguccugcagucccugcucccccagcugcuguacugccgcaagcuccggcuggacacgaaccaguuccaggaccccgugauggagcugcucgggagcgugcuguccggcaaggacugccgcauccagaagaucagccuggccgagaaccagaucuccaacaagggggccaaggcccucgcgcggagccugcuggucaaccgcucccucaccagccuggaccugcggggcaacuccaucgggccgcagggcgccaaggcccucgccgacgcccugaagaucaaccgcacccugaccagccucucccugcagggcaacacggugcgggacgacggggcgcgcagcauggccgaggcccuggccuccaaccggacccucagcaugcugcaccuccagaagaacuccaucggccccaugggggcccagcgcauggcggacgcccucaagcagaaccggagccugaaggagcugauguucagcuccaacagcaucggcgacgggggcgccaaggcccucgccgaggcgcugaaggugaaccagggccuggagucccucgaccugcagagcaacuccaucagcgacgccggggucgccgcccugaugggcgcccucugcaccaaccagacccugcugucccucagccugcgcgagaacuccaucagccccgagggggcgcaggccaucgcccacgcccugugcgcgaacuccacgcucaagaaccuggaccugaccgccaaccuccugcacgaccagggcgcccgggccaucgccguggcggugcgcgagaaccgcacccugaccagccuccaccuccaguggaacuucauccaggccggcgccgcccaggcccuggggcaggcgcugcagcugaaccggucccugaccagccucgaccugcaggagaacgccaucggcgacgacggggccugcgccgucgcccgcgcgcugaaggugaacacggcccugaccgcccucuaccuccagguggccuccaucggcgcgagcggggcccagguccugggcgaggcccuggccgugaaccggacccuggagauccuggaccuccgcggcaacgccaucgggguggcgggcgccaaggcccuggccaacgcccugaaggucaacuccagccuccggcgccugaaccugcaggagaacucccucgggauggacggcgcgaucugcaucgccaccgcccugagcgggaaccaccggcugcagcacaucaaccuccagggcaaccacaucggcgacagcggggcccgcaugaucuccgaggccaucaagacgaacgcgcccacgugcaccguggagauguga

SEQ ID NO: 9175 - RNA, 3339 nt, Artificial Sequence
  derived and/or modified sequence opt2 from NOD3__Homo_sapiens__EAW85351
auggagauggacgccccccgcccccccucccucgccguccccggcgccgccucccgccccggccgccuccucgacggcggccacggccgccagcagguccaggcccucuccucccagcuccucgaggucauccccgacuccaugcgcaagcaggagguccgcaccggccgcgaggccggccagggccacggcaccggcucccccgccgagcaggucaaggcccucauggaccuccucgccggcaagggcucccagggcucccaggccccccaggcccucgaccgcacccccgacgccccccucggccccugcuccaacgacucccgcauccagcgccaccgcaaggcccuccucuccaaggucggcggcggccccgagcucggcggccccuggcaccgccucgccucccuccuccucgucgagggccucaccgaccuccagcuccgcgagcacgacuucacccaggucgaggccacccgcggcggcggccaccccgcccgcaccgucgcccucgaccgccucuuccucccccucucccgcgucuccguccccccccgcgucuccaucaccaucggcgucgccggcaugggcaagaccacccucguccgccacuucguccgccucugggcccacggccaggucggcaaggacuucucccucguccucccccucaccuuccgcgaccucaacacccacgagaagcucugcgccgaccgccucaucugcuccgucuucccccacgucggcgagcccucccucgccgucgccguccccgcccgcgcccuccucauccucgacggccucgacgagugccgcaccccccucgacuucuccaacaccgucgccugcaccgaccccaagaaggagauccccgucgaccaccucaucaccaacaucauccgcggcaaccucuuccccgaggucuccaucuggaucaccucccgccccuccgccuccggccagauccccggcggccucgucgaccgcaugaccgagauccgcggcuucaacgaggaggagaucaaggucugccucgagcagauguuccccgaggaccaggcccuccucggcuggaugcucucccagguccaggccgaccgcgcccucuaccucaugugcaccguccccgccuucugccgccucaccggcauggcccucggccaccucuggcgcucccgcaccggcccccaggacgccgagcucuggcccccccgcacccucugcgagcucuacuccugguacuuccgcauggcccucuccggcgagggccaggagaagggcaaggccuccccccgcaucgagcaggucgcccacggcggccgcaagauggucggcacccucggccgccucgccuuccacggccuccucaagaagaaguacgucuucuacgagcaggacaugaaggccuucggcgucgaccucgcccuccuccagggcgcccccugcuccugcuuccuccagcgcgaggagacccucgccuccuccgucgccuacugcuucacccaccucucccuccaggaguucgucgccgccgccuacuacuacggcgccucccgccgcgccaucuucgaccucuucaccgaguccggcgucuccuggccccgccucggcuuccucacccacuuccgcuccgccgcccagcgcgccaugcaggccgaggacggccgccucgacgucuuccuccgcuuccucuccggccuccucuccccccgcgucaacgcccuccucgccggcucccuccucgcccagggcgagcaccaggccuaccgcacccaggucgccgagcuccuccagggcugccuccgccccgacgccgccgucugcgcccgcgccaucaacguccuccacugccuccacgagcuccagcacaccgagcucgcccgcuccgucgaggaggccauggaguccggcgcccucgcccgccucaccggccccgcccaccgcgccgcccucgccuaccuccuccaggucuccgacgccugcgcccaggaggccaaccucucccucucccucucccagggcguccuccagucccuccucccccagcuccucuacugccgcaagcuccgccucgacaccaaccaguuccaggaccccgucauggagcuccucggcuccguccucuccggcaaggacugccgcauccagaagaucucccucgccgagaaccagaucuccaacaagggcgccaaggcccucgcccgcucccuccucgucaaccgcucccucaccucccucgaccuccgcggcaacuccaucggcccccagggcgccaaggcccucgccgacgcccucaagaucaaccgcacccucaccucccucucccuccagggcaacaccguccgcgacgacggcgcccgcuccauggccgaggcccucgccuccaaccgcacccucuccaugcuccaccuccagaagaacuccaucggccccaugggcgcccagcgcauggccgacgcccucaagcagaaccgcucccucaaggagcucauguucuccuccaacuccaucggcgacggcggcgccaaggcccucgccgaggcccucaaggucaaccagggccucgagucccucgaccuccaguccaacuccaucuccgacgccggcgucgccgcccucaugggcgcccucugcaccaaccagacccuccucucccucucccuccgcgagaacuccaucucccccgagggcgcccaggccaucgcccacgcccucugcgccaacuccacccucaagaaccucgaccucaccgccaaccuccuccacgaccagggcgcccgcgccaucgccgucgccguccgcgagaaccgcacccucaccucccuccaccuccaguggaacuucauccaggccggcgccgcccaggcccucggccaggcccuccagcucaaccgcucccucaccucccucgaccuccaggagaacgccaucggcgacgacggcgccugcgccgucgcccgcgcccucaaggucaacaccgcccucaccgcccucuaccuccaggucgccuccaucggcgccuccggcgcccagguccucggcgaggcccucgccgucaaccgcacccucgagauccucgaccuccgcggcaacgccaucggcgucgccggcgccaaggcccucgccaacgcccucaaggucaacuccucccuccgccgccucaaccuccaggagaacucccucggcauggacggcgccaucugcaucgccaccgcccucuccggcaaccaccgccuccagcacaucaaccuccagggcaaccacaucggcgacuccggcgcccgcaugaucuccgaggccaucaagaccaacgcccccaccugcaccgucgagauguga

SEQ ID NO: 9176 - RNA, 3339 nt, Artificial Sequence
  derived and/or modified sequence opt3 from NOD3__Homo_sapiens__EAW85351
auggagauggacgcccccagaccuccaagccuggcugugccgggcgcagccuccaggcccgggcggcuccuugauggaggucacggccgccagcaaguccaggcgcugucuucacaguuguuagaaguuaucccugacaguaugcgaaagcaggaggugcguaccgggagagaagcuggacaaggccaugguacagggagcccagccgagcagguaaaagcacugauggaucuacucgccggaaagggcucccagggcucucaggcuccccaagcacuggacaggacuccugaugccccacuugggcccugcucgaacgacucacggauucagcgccacagaaaagcucuguugagcaaggugggagguggcccugaacucgggggaccauggcauaggcuggccagucugcucuuagucgagggccugacggaucuucaguugcgggagcacgacuucacccagguggaagcgacacgcggugggggacauccggcacgaacuguugcccuggauagacuauuucucccccuguccagggugucugucccuccacgggugagcauaaccaucggcguagcuggcauggggaaaacaacccuuguucgucacuucgugcgccugugggcccacggacaagucgguaaggacuuuuccuuggugcucccccugacuuucagagauuuaaauacacaugagaagcugugugcagacaggcucauuugcucaguguuuccucacgucggcgaaccaagucuugcuguugccgugcccgcgcgggcccuguugauccuagaugggcuggacgagugucgaaccccgcucgacuucagcaacacgguagcaugcacugauccuaaaaaggagauucccguggaccaucugaucaccaauauaauccgcggaaaccuuuuuccagaagucucuauuuggaucacauccagaccuucagcuagcggccagauucccggugggcugguggauaggaugacugagauccggggcuucaaugaagaggaaauaaaaguuuguuuggagcagauguuuccagaggaccaagcccuccugggauggauguuaagucaggugcaggcugaucgcgcccuguaccuaaugugcaccguccccgcauucuguagacucacaggcauggcccuggggcaccuuuggaggucucguaccggaccucaggacgcugaauuguggccaccgcggacgcugugcgagcucuauuccugguacuuucgaauggcgcugagcggugaaggccaagagaaggggaaagcaucgcccagaauugaacagguggcccacggaggcaggaagaugguagguacucuugggcgccuggcuuuccauggcuugcucaagaaaaaguauguguuuuacgagcaggauaugaaagccuucggaguggaccuggcauuacugcagggcgccccuuguucuugcuuccuacaacgggaggaaacacucgcuuccucagucgccuauuguuuuacccaccugagucuucaggaguucguggcagcggcuuacuauuacggggccagcagaagggcaaucuuugauuuguucacugaauccggagucucuuggccacgccuggguuuucucacacauuuccgaagcgccgcucagcgggccaugcaggcagaggacggccgucuggauguguuuuuaagauuccugucagggcuuuugagucccaggguuaacgcucuccuggccggaucccuacuggcgcaaggcgaacaccaggccuaccgcacccagguggcugagcuccugcaggguugccuucggccugacgcagccguaugcgcuagagccauuaaugucuugcauugucugcacgaguuacaacacacggaacucgcaaggagcguggaggaagcgauggagucuggggcccuggcucgacuuaccggcccagcccaucgcgcagcucuggccuauuugcuccagguuucagacgcaugcgcccaggaggcuaaccugagucuaagccugucccaaggagugcuccagucucugcuuccccaguugcuguacugucggaaguuaagacucgauacaaaucaguuucaagacccggucauggaacugcuuggcucggugcugagcgggaaagauugcaggauccagaagaucucccuagcggagaaccagauuucaaauaaaggagccaaggcacucgcucguagucuguugguaaaccgcucucugacuagcuuagaccuccggggcaauuccauagguccucagggggccaaggcccuggcugaugcacuuaaaaucaacagaacccugacaucauugagccuccaaggaaauacugugagggacgauggcgcccgaucuauggcggaagcucuggccuccaaccggacccuaaguaugcugcaccuucagaagaacagcauugguccaaugggcgcacagcgcauggccgacgcucucaaacagaauagaucucugaaggaguugauguucuccucaaacaguaucggggauggaggcgcaaaagcccuggcggaagcguuaaagguuaaucaagggcucgagagccuggaccuucagucgaacuccauaucugaugccggagucgcagcccugaugggcgcuuuguguacaaaucagacccuccugagccuaucacugagggagaacaguauuucccccgaaggugcccaagcaaucgcucaugcccuuugcgcuaauucuacucucaagaaccuggacuugacggccaauuuacugcacgaucagggggcacgggcuaucgccguggcugugcgagagaacagaacacucaccagccugcaccuucaguggaauuuuauucaggcaggagccgcccaagcucugggccaggcguugcagcuaaaccgcucccugacuucacucgaccugcaggaaaaugcaaucggugacgauggcgccugugcugucgccagggcacuuaaaguuaacaccgccuuaacagcucuguaucuccaaguggcgagcauuggggccaguggagcacagguguugggcgaggcucuggccguaaaucguacccucgaaauacuggaccuucgggggaacgcaaucggagucgccggcgcuaaggcccuggcgaacgcauugaaaguuaauucuucccuaagaaggcugaaccuccaggagaauagcuuagguauggauggggccauuugcaucgcuacugcccugucgggaaaccaucgccuucagcacaucaaucugcaaggcaaccauauuggugacucaggcgcucgaaugauaucugaggcaaucaagacaaaugccccuacguguaccguugaaauguga

SEQ ID NO: 9177 - RNA, 3339 nt, Artificial Sequence
  derived and/or modified sequence opt4 from NOD3__Homo_sapiens__EAW85351
auggagauggacgcccccagaccccccagccuggccgugcccggcgccgccagcagacccggcagacugcuggacggcggccacggcagacagcaggugcaggcccugagcagccagcugcuggaggugauccccgacagcaugagaaagcaggaggugagaaccggcagagaggccggccagggccacggcaccggcagccccgccgagcaggugaaggcccugauggaccugcuggccggcaagggcagccagggcagccaggccccccaggcccuggacagaacccccgacgccccccugggccccugcagcaacgacagcagaauccagagacacagaaaggcccugcugagcaaggugggcggcggccccgagcugggcggccccuggcacagacuggccagccugcugcugguggagggccugaccgaccugcagcugagagagcacgacuucacccagguggaggccaccagaggcggcggccaccccgccagaaccguggcccuggacagacuguuccugccccugagcagagugagcgugccccccagagugagcaucaccaucggcguggccggcaugggcaagaccacccuggugagacacuucgugagacugugggcccacggccaggugggcaaggacuucagccuggugcugccccugaccuucagagaccugaacacccacgagaagcugugcgccgacagacugaucugcagcguguucccccacgugggcgagcccagccuggccguggccgugcccgccagagcccugcugauccuggacggccuggacgagugcagaaccccccuggacuucagcaacaccguggccugcaccgaccccaagaaggagauccccguggaccaccugaucaccaacaucaucagaggcaaccuguuccccgaggugagcaucuggaucaccagcagacccagcgccagcggccagauccccggcggccugguggacagaaugaccgagaucagaggcuucaacgaggaggagaucaaggugugccuggagcagauguuccccgaggaccaggcccugcugggcuggaugcugagccaggugcaggccgacagagcccuguaccugaugugcaccgugcccgccuucugcagacugaccggcauggcccugggccaccuguggagaagcagaaccggcccccaggacgccgagcuguggccccccagaacccugugcgagcuguacagcugguacuucagaauggcccugagcggcgagggccaggagaagggcaaggccagccccagaaucgagcagguggcccacggcggcagaaagauggugggcacccugggcagacuggccuuccacggccugcugaagaagaaguacguguucuacgagcaggacaugaaggccuucggcguggaccuggcccugcugcagggcgcccccugcagcugcuuccugcagagagaggagacccuggccagcagcguggccuacugcuucacccaccugagccugcaggaguucguggccgccgccuacuacuacggcgccagcagaagagccaucuucgaccuguucaccgagagcggcgugagcuggcccagacugggcuuccugacccacuucagaagcgccgcccagagagccaugcaggccgaggacggcagacuggacguguuccugagauuccugagcggccugcugagccccagagugaacgcccugcuggccggcagccugcuggcccagggcgagcaccaggccuacagaacccagguggccgagcugcugcagggcugccugagacccgacgccgccgugugcgccagagccaucaacgugcugcacugccugcacgagcugcagcacaccgagcuggccagaagcguggaggaggccauggagagcggcgcccuggccagacugaccggccccgcccacagagccgcccuggccuaccugcugcaggugagcgacgccugcgcccaggaggccaaccugagccugagccugagccagggcgugcugcagagccugcugccccagcugcuguacugcagaaagcugagacuggacaccaaccaguuccaggaccccgugauggagcugcugggcagcgugcugagcggcaaggacugcagaauccagaagaucagccuggccgagaaccagaucagcaacaagggcgccaaggcccuggccagaagccugcuggugaacagaagccugaccagccuggaccugagaggcaacagcaucggcccccagggcgccaaggcccuggccgacgcccugaagaucaacagaacccugaccagccugagccugcagggcaacaccgugagagacgacggcgccagaagcauggccgaggcccuggccagcaacagaacccugagcaugcugcaccugcagaagaacagcaucggccccaugggcgcccagagaauggccgacgcccugaagcagaacagaagccugaaggagcugauguucagcagcaacagcaucggcgacggcggcgccaaggcccuggccgaggcccugaaggugaaccagggccuggagagccuggaccugcagagcaacagcaucagcgacgccggcguggccgcccugaugggcgcccugugcaccaaccagacccugcugagccugagccugagagagaacagcaucagccccgagggcgcccaggccaucgcccacgcccugugcgccaacagcacccugaagaaccuggaccugaccgccaaccugcugcacgaccagggcgccagagccaucgccguggccgugagagagaacagaacccugaccagccugcaccugcaguggaacuucauccaggccggcgccgcccaggcccugggccaggcccugcagcugaacagaagccugaccagccuggaccugcaggagaacgccaucggcgacgacggcgccugcgccguggccagagcccugaaggugaacaccgcccugaccgcccuguaccugcagguggccagcaucggcgccagcggcgcccaggugcugggcgaggcccuggccgugaacagaacccuggagauccuggaccugagaggcaacgccaucggcguggccggcgccaaggcccuggccaacgcccugaaggugaacagcagccugagaagacugaaccugcaggagaacagccugggcauggacggcgccaucugcaucgccaccgcccugagcggcaaccacagacugcagcacaucaaccugcagggcaaccacaucggcgacagcggcgccagaaugaucagcgaggccaucaagaccaacgcccccaccugcaccguggagauguga

SEQ ID NO: 9178 - RNA, 3339 nt, Artificial Sequence
  derived and/or modified sequence opt5 from NOD3__Homo_sapiens__EAW85351
auggagauggacgcccccagaccuccgagccuggcugugcccggcgccgcgucccggccugggcgccuccuggauggaggccacgggagacagcaaguccaggcucuuucuagccagcugcucgaaguuauccccgacuccaugcggaagcaggaggugcgcaccggaagagaagccggccaagggcauggaacaggcucuccugccgaacaggugaaagcucugauggaucuucuggccggcaaggggagccagggaucccaggcuccccaagcccucgaccggacgccugaugcgccgcugggccccugcucuaacgacagccgcauucagagacaccggaaagcccugcucuccaaggucgggggaggcccugagcuugggggacccuggcaucgccuugcuagccugcuccugguggagggccuuaccgaucugcagcucagagagcacgacuucacacagguugaagccacccggggcgggggacauccugcucgcacaguggcccuggauagacuguuucucccccugucucgggucuccgugccgccucgcguuagcaucaccauuggcguggcggggaugggaaaaacaacccuugucagacacuucgugcggcugugggcccacggccaaguggggaaggacuuuucucucguccugccccuuacguucagagaucugaauacccaugagaagcucugugcugaccgccugaucugcuccguuuuuccucacgugggagaacccagccuggccguggcuguccccgcccgggcccuccugauucuugauggccuggacgaguguagaacaccucucgacuucucuaacaccguggcuugcacagauccgaaaaaggagauccccguugaccaucugaucaccaauauuauccgcggcaaccuuuuuccugaaguguccauuuggaucacgagccggcccuccgcgucugggcagauuccuggaggccuggucgauagaaugacagagauccgcggguucaaugaagaggaaauuaaagugugucucgagcagauguuucccgaggaccaagcccugcugggauggaugcucagccagguucaggcugaucgggcccuguaccuuaugugcaccgugccggccuucuguagacugacaggcauggcucucgggcaccuguggcgcucccggaccggcccucaggacgccgaacuguggcccccuagaacccuuugcgagcucuauagcugguacuuucgcauggcgcugucuggagaaggccaagagaaggggaaagcuagcccccggaucgaacaggucgcccacggaggcagaaagaugguggggacacugggacggcucgccuuccauggccugcuuaagaaaaaguaugucuuuuacgagcaggauaugaaggcuuucgggguggaccuggcccuccugcagggcgcuccuuguuccugcuuccugcaacgcgaggaaacgcuugccucuagcguugcguauuguuuuacccaccucucccugcaggaguucguggccgcugccuacuauuacggagcuucuagacgggccaucuuugaucuguucacagaaagcggcgucuccuggcccagacucggguuucugacccauuuccgcagcgcggcccagcgggcuaugcaggccgaggacggaagacuugauguguuucugcgcuuccucucuggccugcuguccccgagaguuaacgcucugcucgccgggagccugcuggcccaaggagaacaccaggcuuaccggacacagguggcggagcuccugcagggcugccuucgcccugacgccgcugucugcgccagagccauuaaugugcugcauugucuccacgagcugcaacacaccgaacuggcucggucuguggaggaagccauggaguccggggcgcuugcucgccucacgggccccgcccauagagccgcucuggccuaucugcuccagguuagcgacgcgugcgcucaggaggccaaccugucccuuucucugagccaaggaguccuccagucccugcugccccagcuucuguacugucggaaacuccgccuggauacaaaucaguuucaagacccugugauggaacuccugggcucugugcuuagcgggaaagauugcagaauccagaagauuucccuggccgagaaccagaucagcaauaaaggagcuaaggcccucgcucggucucugcuggucaaccgcucccuuaccagccuggaccucagaggcaauucuauugggccgcagggagccaaggcgcuggccgaugcucucaaaaucaaccggacccugacaucccuuagccugcaaggcaauaccgugagagacgauggggcccgcucuauggcugaagcccucgccagcaaccggacacuguccaugcugcaccuucagaagaacagcaucggccccaugggagcucagagaauggcggacgcccugaaacagaaucgcucucucaaggagcugauguucuccagcaacuccauuggcgaugggggagcuaaagcccucgccgaagcucugaagguuaaucaaggccuugagucucuggaccugcagagcaacuccaucucugaugccgggguggcggcucucaugggagcccuguguacgaaucagacccuucugagccucucccugcgggagaacucuauuagcccugaaggcgcccaagcuaucgcccaugcgcucugcgcuaauuccacacugaagaaccuugaccugaccgccaaucugcuccacgaucagggcgccagagcuauugccgucgcugugcgcgagaaccggacacugaccagccuucaucugcaguggaauuuuauccaggccggggcggcccaagcucucggacaggcccugcagcucaacagaucucugacgucccuugaccugcaggaaaaugcuaucggcgacgauggggccugugccguugcucgcgcgcugaaagugaacaccgcccucacagcucuguaucuucaagucgccagcauuggagccucuggcgcucaggugcugggggaggcccucgcgguuaaucggacccuggaaauccucgaccugagaggaaacgcuauuggcguggccggcgccaaggcucuugccaacgcgcugaaagucaauuccagccugcggcgccucaaccugcaggaaaauucucuugggauggauggagccaucugcauugcuacagcccuguccggcaaccacagacuccagcacaucaaucugcaagggaaccauauuggagacagcggcgcucggaugaucuccgaggccaucaagaccaaugcucccacguguacaguggagauguga

SEQ ID NO: 9179 - protein, 1065 aa, Artificial Sequence; identical to SEQ ID NO: 9165
  NOD3__Homo_sapiens__Q7RTR2

SEQ ID NO: 9180 - RNA, 3198 nt, Artificial Sequence
  NOD3__Homo_sapiens__AAT48367
augaggaagcaagaggugcggacgggcagggaggccggccagggccacgguacgggcuccccagccgagcaggugaaagcccucauggaucugcuggcugggaagggcagucaaggcucccaggccccgcaggcccuggauaggacaccggaugccccgcuggggcccugcagcaaugacucaaggauacagaggcaccgcaaggcccugcugagcaaggugggagguggcccggagcugggcggacccuggcacaggcuggccucccuccugcugguggagggccugacggaccugcagcugagggaacacgacuucacacagguggaggccacccgcgggggcgggcaccccgccaggaccgucgcccuggaccggcucuuccugccucucucccgggugucugucccaccccgggucuccaucacuaucgggguggccggcaugggcaagaccacccuggugaggcacuucguccgccucugggcccaugggcaggucggcaaggacuucucgcuggugcugccucugaccuuccgggaucucaacacccacgagaagcugugugccgaccgacucaucugcucggucuucccgcacgucggggagcccagccuggcgguggcagucccagccagggcccuccugauccuggacggcuuggaugagugcaggacgccucuggacuucuccaacaccguggccugcacggacccaaagaaggagaucccgguggaccaccugaucaccaacaucauccguggcaaccucuuuccggaaguuuccaucuggaucaccucccgucccagugcaucuggccagaucccagggggccugguggaccggaugacggagauccggggcuuuaacgaggaggagaucaagguguguuuggagcagauguuccccgaggaccaggcccuucugggcuggaugcugagccaagugcaggcugacagggcccuguaccugaugugcaccgucccagccuucugcaggcucacggggauggcgcuaggccaccuguggcgcagcaggacggggccccaggaugcagagcuguggcccccgaggacccugugcgagcucuacucaugguacuuuaggauggcccucagcggggaggggcaggagaagggcaaggcaagcccucgcaucgagcagguggcccaugguggccgcaagaugguggggacauugggccgucuggccuuccaugggcugcucaagaagaaauacguguuuuacgagcaagacaugaaggcguuugguguagaccucgcucugcugcagggcgccccgugcagcugcuuccugcagagagaggagacguuggcaucgucaguggccuacugcuucacccaccugucccugcaggaguuuguggcagccgcguauuacuauggcgcauccaggagggccaucuucgaccucuucacugagagcggcguauccuggcccaggcugggcuuccucacgcauuucaggagcgcagcccagcgggccaugcaggcagaggacgggaggcuggacguguuccugcgcuuccucuccggccucuugucuccgagggucaaugcccuccuggccggcucccugcuggcccaaggcgagcaccaggccuaccggacccagguggcugagcuccugcagggcugccugcgccccgaugccgcagucugugcacgggccaucaacguguugcacugccugcaugagcugcagcacacugagcuggcccgcagcguggaggaggccauggagagcggggcccuggccaggcugaccggucccgcgcaccgcgcugcccuggccuaccuccugcagguguccgacgccugugcccaggaggccaaccugucccugagccucagccagggcguccuucagagccugcugccccagcugcucuacugccggaagcucaggcuggacaccaaccaguuccaggaccccgugauggagcugcugggcagcgugcugagugggaaggacugucgcauucagaagaucagcuuggcggagaaccagaucaguaacaaaggggccaaagcucuggccagaucccucuuggucaacagaagucugaccucucuggaccuccgcgguaacuccauuggaccacaaggggccaaggcgcuggcagacgcuuugaagaucaaccgcacccugaccucccugagccuccagggcaacaccguuagggaugauggugccagguccauggcugaggccuuggccuccaaccggacccucuccaugcugcaccugcagaagaacagcaucgggcccaugggagcccagcggauggcagaugccuugaagcagaacaggagucugaaagagcucauguucuccaguaauaguauuggugauggaggugccaaggcccuggcugaggcccugaaggugaaccagggccuggagagccuggaccugcagagcaauuccaucagugacgcaggaguggcagcacugaugggggcccucugcaccaaccagacccuccucagccucagccuucgagaaaacuccaucagucccgagggagcccaggccaucgcucaugcccucugcgccaacagcacccugaagaaccuggaccugacagccaaccuccuccacgaccagggugcccgggccaucgcaguggcagugagagaaaaccgcacccucaccucccuucaccugcaguggaacuucauccaggccggcgcugcccaggcccugggacaagcacuacagcucaacaggagccucaccagcuuagauuuacaggagaacgccaucggggaugacggagcgugugcgguggcccgugcacugaaggucaacacagcccucacugcucucuaucuccagguggccucaauuggugcuucaggcgcccaggugcuaggggaagccuuggcugugaacagaaccuuggagauucucgacuuaagaggaaaugccauugggguggcuggagccaaagcccuggcaaaugcucugaagguaaacucaagucuccggagacucaaucuucaagagaauucucuggggauggacggggcgauaugcauugccacagcacugucuggaaaccacaggcuccagcauaucaaucuccagggaaaccacauuggggacuccggggccaggaugaucucagaggccaucaagacaaaugcucccacgugcacuguugaaauguga

SEQ ID NO: 9181 - RNA, 3198 nt, Artificial Sequence; identical to SEQ ID NO: 9167
  derived and/or modified sequence opt1 from NOD3__Homo_sapiens__AAT48367

SEQ ID NO: 9182 - RNA, 3198 nt, Artificial Sequence; identical to SEQ ID NO: 9168
  derived and/or modified sequence opt2 from NOD3__Homo_sapiens__AAT48367

SEQ ID NO: 9183 - RNA, 3198 nt, Artificial Sequence; identical to SEQ ID NO: 9169
  derived and/or modified sequence opt3 from NOD3__Homo_sapiens__AAT48367

SEQ ID NO: 9184 - RNA, 3198 nt, Artificial Sequence; identical to SEQ ID NO: 9170
  derived and/or modified sequence opt4 from NOD3__Homo_sapiens__AAT48367

SEQ ID NO: 9185 - RNA, 3198 nt, Artificial Sequence; identical to SEQ ID NO: 9171
  derived and/or modified sequence opt5 from NOD3__Homo_sapiens__AAT48367

SEQ ID NO: 9186 - protein, 1044 aa, Artificial Sequence
  PI3K__Homo_sapiens__O00329
MPPGVDCPMEFWTKEENQSVVVDFLLPTGVYLNFPVSRNANLSTIKQLLWHRAQYEPLFHMLSGPEAYVFTCINQTAEQQELEDEQRRLCDVQPFLPVLRLVAREGDRVKKLINSQISLLIGKGLHEFDSLCDPEVNDFRAKMCQFCEEAAARRQQLGWEAWLQYSFPLQLEPSAQTWGPGTLRLPNRALLVNVKFEGSEESFTFQVSTKDVPLALMACALRKKATVFRQPLVEQPEDYTLQVNGRHEYLYGSYPLCQFQYICSCLHSGLTPHLTMVHSSSILAMRDEQSNPAPQVQKPRAKPPPIPAKKPSSVSLWSLEQPFRIELIQGSKVNADERMKLVVQAGLFHGNEMLCKTVSSSEVSVCSEPVWKQRLEFDINICDLPRMARLCFALYAVIEKAKKARSTKKKSKKADCPIAWANLMLFDYKDQLKTGERCLYMWPSVPDEKGELLNPTGTVRSNPNTDSAAALLICLPEVAPHPVYYPALEKILELGRHSECVHVTEEEQLQLREILERRGSGELYEHEKDLVWKLRHEVQEHFPEALARLLLVTKWNKHEDVAQMLYLLCSWPELPVLSALELLDFSFPDCHVGSFAIKSLRKLTDDELFQYLLQLVQVLKYESYLDCELTKFLLDRALANRKIGHFLFWHLRSEMHVPSVALRFGLILEAYCRGSTHHMKVLMKQGEALSKLKALNDFVKLSSQKTPKPQTKELMHLCMRQEAYLEALSHLQSPLDPSTLLAEVCVEQCTFMDSKMKPLWIMYSNEEAGSGGSVGIIFKNGDDLRQDMLTLQMIQLMDVLWKQEGLDLRMTPYGCLPTGDRTGLIEVVLRSDTIANIQLNKSNMAATAAFNKDALLNWLKSKNPGEALDRAIEEFTLSCAGYCVATYVLGIGDRHSDNIMIRESGQLFHIDFGHFLGNFKTKFGINRERVPFILTYDFVHVIQQGKTNNSEKFERFRGYCERAYTILRRHGLLFLHLFALMRAAGLPELSCSKDIQYLKDSLALGKTEEEALKHFRVKFNEALRESWKTKVNWLAHNVSKDNRQ

SEQ ID NO: 9187 - RNA, 3135 nt, Artificial Sequence
  PI3K__Homo_sapiens__AAI32920
augcccccugggguggacugccccauggaauucuggaccaaggaggagaaucagagcguugugguugacuuccugcugcccacaggggucuaccugaacuucccugugucccgcaaugccaaccucagcaccaucaagcagcugcuguggcaccgcgcccaguaugagccgcucuuccacaugcucaguggccccgaggccuauguguucaccugcaucaaccagacagcggagcagcaagagcuggaggacgagcaacggcgucugugugacgugcagcccuuccugcccguccugcgccugguggcccgugagggcgaccgcgugaagaagcucaucaacucacagaucagccuccucaucggcaaaggccuccacgaguuugacuccuugugcgacccagaagugaacgacuuucgcgccaagaugugccaauucugcgaggaggcggccgcccgccggcagcagcugggcugggaggccuggcugcaguacaguuucccccugcagcuggagcccucggcucaaaccugggggccugguacccugcggcucccgaaccgggcccuucuggucaacguuaaguuugagggcagcgaggagagcuucaccuuccagguguccaccaaggacgugccgcuggcgcugauggccugugcccugcggaagaaggccacaguguuccggcagccgcugguggagcagccggaagacuacacgcugcaggugaacggcaggcaugaguaccuguauggcagcuacccgcucugccaguuccaguacaucugcagcugccugcacaguggguugaccccucaccugaccaugguccauuccuccuccauccucgccaugcgggaugagcagagcaacccugccccccagguccagaaaccgcgugccaaaccaccucccauuccugcgaagaagccuuccucugugucccuguggucccuggagcagccguuccgcaucgagcucauccagggcagcaaagugaacgccgacgagcggaugaagcugguggugcaggccgggcuuuuccacggcaacgagaugcugugcaagacgguguccagcucggaggugagcgugugcucggagcccguguggaagcagcggcuggaguucgacaucaacaucugcgaccugccccgcauggcccgucucugcuuugcgcuguacgccgugaucgagaaagccaagaaggcucgcuccaccaagaagaaguccaagaaggcggacugccccauugccugggccaaccucaugcuguuugacuacaaggaccagcuuaagaccggggaacgcugccucuacauguggcccuccgucccagaugagaagggcgagcugcugaaccccacgggcacugugcgcaguaaccccaacacggauagcgccgcugcccugcucaucugccugcccgagguggccccgcaccccguguacuaccccgcccuggagaagaucuuggagcuggggcgacacagcgagugugugcaugucaccgaggaggagcagcugcagcugcgggaaauccuggagcggcgggggucuggggagcuguaugagcacgagaaggaccugguguggaagcugcggcaugaaguccaggagcacuucccggaggcgcuagcccggcugcugcuggucaccaaguggaacaagcaugaggauguggcccagaugcucuaccugcugugcuccuggccggagcugcccguccugagcgcccuggagcugcuagacuucagcuuccccgauugccacguaggcuccuucgccaucaagucgcugcggaaacugacggacgaugagcuguuccaguaccugcugcagcuggugcaggugcucaaguacgaguccuaccuggacugcgagcugaccaaauuccugcuggaccgggcccuggccaaccgcaagaucggccacuuccuuuucuggcaccuccgcuccgagaugcacgugccgucgguggcccugcgcuucggccucauccuggaggccuacugcaggggcagcacccaccacaugaaggugcugaugaagcagggggaagcacugagcaaacugaaggcccugaaugacuucgucaagcugagcucucagaagacccccaagccccagaccaaggagcugaugcacuugugcaugcggcaggaggccuaccuagaggcccucucccaccugcaguccccacucgaccccagcacccugcuggcugaagucugcguggagcagugcaccuucauggacuccaagaugaagccccuguggaucauguacagcaacgaggaggcaggcagcggcggcagcgugggcaucaucuuuaagaacggggaugaccuccggcaggacaugcugacccugcagaugauccagcucauggacguccuguggaagcaggaggggcuggaccugaggaugacccccuauggcugccuccccaccggggaccgcacaggccucauugaggugguacuccguucagacaccaucgccaacauccaacucaacaagagcaacauggcagccacagccgccuucaacaaggaugcccugcucaacuggcugaaguccaagaacccgggggaggcccuggaucgagccauugaggaguucacccucuccugugcuggcuauuguguggccacauaugugcugggcauuggcgaucggcacagcgacaacaucaugauccgagagagugggcagcuguuccacauugauuuuggccacuuucuggggaauuucaagaccaaguuuggaaucaaccgcgagcgugucccauucauccucaccuacgacuuuguccaugugauucagcaggggaagacuaauaauagugagaaauuugaacgguuccggggcuacugugaaagggccuacaccauccugcggcgccacgggcuucucuuccuccaccucuuugcccugaugcgggcggcaggccugccugagcucagcugcuccaaagacauccaguaucucaaggacucccuggcacuggggaaaacagaggaggaggcacugaagcacuuccgagugaaguuuaacgaagcccuccgugagagcuggaaaaccaaagugaacuggcuggcccacaacguguccaaagacaacaggcaguag

SEQ ID NO: 9188 - RNA, 3135 nt, Artificial Sequence
  derived and/or modified sequence opt1 from PI3K__Homo_sapiens__AAI32920
augcccccgggcguggacugccccauggaguucuggaccaaggaggagaaccagagcgucgugguggacuuccugcuccccaccggggucuaccugaacuuccccgugucccgcaacgccaaccugagcacgaucaagcagcuccuguggcaccgggcccaguacgagccgcuguuccacaugcucuccggccccgaggcguacguguucacgugcaucaaccagaccgccgagcagcaggagcuggaggacgagcagcgccggcugugcgacguccagcccuuccuccccgugcugcgccugguggcccgggagggggaccgcgucaagaagcucaucaacagccagaucucccugcugaucggcaaggggcuccacgaguucgacagccugugcgacccggaggugaacgacuuccgggccaagaugugccaguucugcgaggaggccgcggcccgccggcagcagcugggcugggaggccuggcuccaguacuccuucccccugcagcuggagcccagcgcccagaccuggggccccgggacccuccgccugccgaaccgggcgcugcucgugaacgucaaguucgagggcuccgaggagagcuucaccuuccagguguccaccaaggacgugccccuggcccugauggccugcgcccuccgcaagaaggccaccgucuuccggcagccccugguggagcagcccgaggacuacacgcuccaggugaacgggcgccacgaguaccucuacggcagcuacccgcugugccaguuccaguacaucugcuccugccugcacagcgggcucacgccccaccugaccaugguccacuccagcuccauccuggcgaugcgggacgagcagagcaaccccgcgccccaggugcagaagccgcgcgccaagcccccgcccauccccgccaagaagcccuccagcgugagccucuggucccuggagcagcccuuccggaucgagcugauccagggcagcaaggucaacgccgacgagcgcaugaagcucguggugcaggccggccuguuccacgggaacgagaugcugugcaagaccgucuccagcuccgaggugagcgucugcuccgagcccguguggaagcagcggcucgaguucgacaucaacaucugcgaccugccgcgcauggcccggcugugcuucgcccucuacgccgugaucgagaaggccaagaaggcgcgcagcaccaagaagaaguccaagaaggccgacugccccaucgccugggccaaccugaugcuguucgacuacaaggaccagcucaagaccggcgagcgcugccuguacauguggcccagcgucccggacgagaagggggagcugcugaaccccaccggcaccgugcgguccaaccccaacacggacagcgccgcggcccuccugaucugccugcccgagguggccccgcaccccgucuacuaccccgcccucgagaagauccuggagcugggccgccacuccgagugcgugcacgugaccgaggaggagcagcuccagcugcgggagauccuggagcgccgggggagcggcgagcucuacgagcacgagaaggaccuggucuggaagcugcgccacgaggugcaggagcacuuccccgaggcgcucgcccggcugcugcucgugaccaaguggaacaagcacgaggacgucgcccagaugcuguaccugcucugcuccuggccggagcugcccgugcugagcgcccucgagcugcuggacuucuccuuccccgacugccacguggggagcuucgccaucaagucccuccgcaagcugaccgacgacgagcuguuccaguaccuccugcagcugguccaggugcucaaguacgagagcuaccuggacugcgagcugacgaaguuccuccuggaccgggcgcuggccaaccgcaagaucggccacuuccucuucuggcaccuccggagcgagaugcacgugcccuccgucgcccugcgcuucgggcugauccuggaggccuacugccggggcagcacccaccacaugaaggugcugaugaagcagggcgaggcccucuccaagcugaaggcgcugaacgacuucgugaagcucagcucccagaagaccccgaagccccagaccaaggagcugaugcaccugugcaugcgccaggaggccuaccucgaggcccugagccaccuccagagcccccuggaccccuccacgcugcuggccgaggucugcguggagcagugcaccuucauggacuccaagaugaagccgcucuggaucauguacagcaacgaggaggccggguccggcgggagcgugggcaucaucuucaagaacggggacgaccugcggcaggacaugcugacccuccagaugauccagcugauggacguccuguggaagcaggagggccucgaccugcgcaugacccccuacggcugccugcccacgggggaccggaccggccucaucgagguggugcugcgcuccgacaccaucgcgaacauccagcugaacaagagcaacauggccgccaccgccgcguucaacaaggacgcccuccugaacuggcugaaguccaagaaccccggggaggcccucgaccgggccaucgaggaguucacgcugagcugcgccggcuacugcgucgcgaccuacgugcuggggaucggcgaccgccacuccgacaacaucaugauccgcgagagcggccagcuguuccacaucgacuucgggcacuuccugggcaacuucaagaccaaguucgggaucaaccgggagcgcgugccguucauccugaccuacgacuucguccacgugauccagcagggcaagacgaacaacagcgagaaguucgagcgguuccgcggcuacugcgagcgggccuacaccauccuccgccggcacgggcugcuguuccuccaccuguucgcccugaugcgcgccgccggccuccccgagcuguccugcagcaaggacauccaguaccugaaggacucccucgcgcuggggaagaccgaggaggaggcccugaagcacuuccgggugaaguucaacgaggcccuccgcgagagcuggaagaccaaggucaacuggcuggcccacaacguguccaaggacaaccggcaguga

SEQ ID NO: 9189 - RNA, 3135 nt, Artificial Sequence
  derived and/or modified sequence opt2 from PI3K__Homo_sapiens__AAI32920
augccccccggcgucgacugccccauggaguucuggaccaaggaggagaaccaguccgucgucgucgacuuccuccuccccaccggcgucuaccucaacuuccccgucucccgcaacgccaaccucuccaccaucaagcagcuccucuggcaccgcgcccaguacgagccccucuuccacaugcucuccggccccgaggccuacgucuucaccugcaucaaccagaccgccgagcagcaggagcucgaggacgagcagcgccgccucugcgacguccagcccuuccuccccguccuccgccucgucgcccgcgagggcgaccgcgucaagaagcucaucaacucccagaucucccuccucaucggcaagggccuccacgaguucgacucccucugcgaccccgaggucaacgacuuccgcgccaagaugugccaguucugcgaggaggccgccgcccgccgccagcagcucggcugggaggccuggcuccaguacuccuucccccuccagcucgagcccuccgcccagaccuggggccccggcacccuccgccuccccaaccgcgcccuccucgucaacgucaaguucgagggcuccgaggaguccuucaccuuccaggucuccaccaaggacgucccccucgcccucauggccugcgcccuccgcaagaaggccaccgucuuccgccagccccucgucgagcagcccgaggacuacacccuccaggucaacggccgccacgaguaccucuacggcuccuacccccucugccaguuccaguacaucugcuccugccuccacuccggccucaccccccaccucaccaugguccacuccuccuccauccucgccaugcgcgacgagcaguccaaccccgccccccagguccagaagccccgcgccaagcccccccccauccccgccaagaagcccuccuccgucucccucuggucccucgagcagcccuuccgcaucgagcucauccagggcuccaaggucaacgccgacgagcgcaugaagcucgucguccaggccggccucuuccacggcaacgagaugcucugcaagaccgucuccuccuccgaggucuccgucugcuccgagcccgucuggaagcagcgccucgaguucgacaucaacaucugcgaccucccccgcauggcccgccucugcuucgcccucuacgccgucaucgagaaggccaagaaggcccgcuccaccaagaagaaguccaagaaggccgacugccccaucgccugggccaaccucaugcucuucgacuacaaggaccagcucaagaccggcgagcgcugccucuacauguggcccuccguccccgacgagaagggcgagcuccucaaccccaccggcaccguccgcuccaaccccaacaccgacuccgccgccgcccuccucaucugccuccccgaggucgccccccaccccgucuacuaccccgcccucgagaagauccucgagcucggccgccacuccgagugcguccacgucaccgaggaggagcagcuccagcuccgcgagauccucgagcgccgcggcuccggcgagcucuacgagcacgagaaggaccucgucuggaagcuccgccacgagguccaggagcacuuccccgaggcccucgcccgccuccuccucgucaccaaguggaacaagcacgaggacgucgcccagaugcucuaccuccucugcuccuggcccgagcuccccguccucuccgcccucgagcuccucgacuucuccuuccccgacugccacgucggcuccuucgccaucaagucccuccgcaagcucaccgacgacgagcucuuccaguaccuccuccagcucguccagguccucaaguacgaguccuaccucgacugcgagcucaccaaguuccuccucgaccgcgcccucgccaaccgcaagaucggccacuuccucuucuggcaccuccgcuccgagaugcacguccccuccgucgcccuccgcuucggccucauccucgaggccuacugccgcggcuccacccaccacaugaagguccucaugaagcagggcgaggcccucuccaagcucaaggcccucaacgacuucgucaagcucuccucccagaagacccccaagccccagaccaaggagcucaugcaccucugcaugcgccaggaggccuaccucgaggcccucucccaccuccaguccccccucgaccccuccacccuccucgccgaggucugcgucgagcagugcaccuucauggacuccaagaugaagccccucuggaucauguacuccaacgaggaggccggcuccggcggcuccgucggcaucaucuucaagaacggcgacgaccuccgccaggacaugcucacccuccagaugauccagcucauggacguccucuggaagcaggagggccucgaccuccgcaugacccccuacggcugccuccccaccggcgaccgcaccggccucaucgaggucguccuccgcuccgacaccaucgccaacauccagcucaacaaguccaacauggccgccaccgccgccuucaacaaggacgcccuccucaacuggcucaaguccaagaaccccggcgaggcccucgaccgcgccaucgaggaguucacccucuccugcgccggcuacugcgucgccaccuacguccucggcaucggcgaccgccacuccgacaacaucaugauccgcgaguccggccagcucuuccacaucgacuucggccacuuccucggcaacuucaagaccaaguucggcaucaaccgcgagcgcguccccuucauccucaccuacgacuucguccacgucauccagcagggcaagaccaacaacuccgagaaguucgagcgcuuccgcggcuacugcgagcgcgccuacaccauccuccgccgccacggccuccucuuccuccaccucuucgcccucaugcgcgccgccggccuccccgagcucuccugcuccaaggacauccaguaccucaaggacucccucgcccucggcaagaccgaggaggaggcccucaagcacuuccgcgucaaguucaacgaggcccuccgcgaguccuggaagaccaaggucaacuggcucgcccacaacgucuccaaggacaaccgccaguga

SEQ ID NO: 9190 - RNA, 3135 nt, Artificial Sequence
  derived and/or modified sequence opt3 from PI3K__Homo_sapiens__AAI32920
augcccccuggcguggacugcccaauggaguucuggaccaaggaagagaaccagagcgucguuguggauuuucugcucccgacagggguauaccuuaauuuccccguguccagaaacgccaaucugucuacuaucaaacaauuguuauggcacagggcucaguaugaaccucuguuucauaugcuaucaggaccagaggcauacgucuucacguguauuaaccagaccgccgaacagcaagagcucgaggacgaacagcggcgccugugcgaugugcagcccuuucuuccuguucugcgauugguggcgcgugagggugacagagucaagaaacucauaaauagucagaucagccugcugauuggcaaggggcuccacgaguucgauuccuuaugugacccagaggugaacgauuuuagggcuaaaaugugccaauucugugaggaagccgcagcccggcgccagcagcugggaugggaggcuuggcuucaguauucuuuucccuugcaacuggaaccuucggcacagacauggggcccagguacucuaagacucccgaauagggcccugcuuguaaacguuaaguucgaggggucagaagagagcuuuaccuuccaggugaguacaaaggacgucccccuggcuuugauggccugcgcgcuccggaaaaaggcaaccguguuucgccaaccucugguggagcagccagaagauuacacuuuacaggucaauggacgacaugaguaucuguacggcuccuauccccucugucaguuccaauacaucugcucuugucuucacagcggccugacaccucauuugaccaugguucacuccucaaguauucuagccaugagagacgaacagagcaacccagcuccccaggugcagaaaccgagggccaagccucccccaaucccugcuaaaaagcccucuuccguaucacuguggagccucgagcaaccauuccggauagaacugauccaggggaguaaggugaaugcagaugagcguaugaaacuugucgugcaggccggacuguuucacgguaacgagauguugugcaagacgguuucuuccagcgaagugucggucuguucugagcccguguggaaacagcgccucgaguucgacauuaauaucugcgaucugccuagaauggcgagguuaugcuuugcccuguacgcaguaauugaaaaggcuaaaaaggcccgguccacuaaaaagaagaguaaaaaggcugacuguccaaucgccugggcaaaccuaaugcuguucgacuauaaagaucaacucaagaccggcgaacgaugccuuuacauguggccgucaguucccgacgagaaaggggaguugcugaauccuacaggaacugugcgcagcaacccaaacaccgauuccgccgcugcgcuccugauaugucuucccgaagucgcaccucauccaguguauuaccccgcccuggagaagauuuuggaacucggcagacacucugagugcguccaugugacagaggaagaacagcugcaguuaagggaaauccuggagcggcgcgguagcggggaacuauaugagcacgagaaggaccucguuuggaaacugagacacgaagugcaggagcauuuuccggaagcucuugccagguugcugcucguaaccaaguggaauaaacacgaggaugucgcacaaaugcuguacuuacuguguucauggccugaacuuccaguguugagugcccucgagcugcuagacuucuccuuucccgauugccauguuggcagcuucgcuauuaagucucugcguaaacucacggacgaugagcuguuucaguaucuuuugcagcuggugcaagucuuaaaguacgaaucauaccucgacugugagcugacuaaguuccuucuggaucgggccuuggcaaaccgaaaaaucggacacuuucucuucuggcaucugagaagugaaaugcacgugccuagcguagcgcuaagguuuggccugauccucgaggcuuauugccgcggguccacacaccauaugaaggugcugaugaaacagggagaagcccuuucuaaguugaaagcacugaaugacuucguuaaguuaucgagccagaagacccccaaaccacagacuaaggagcucaugcaccuguguaugcggcaagaggccuaccuugaagcucugucccaucuacagucaccucucgaccccaguacacuguuggccgaggucugcguggaacaguguaccuucauggauucuaaaaugaagccacuguggauuauguauagcaacgaggaggcagguuccggcgggucagugggaauaaucuuuaaaaauggcgacgauuuaagacaggacaugcucacgcugcaaaugauucagcuuauggauguccuguggaagcaggaagguuuggaccucaggaugaccccguacgggugccugccuacaggcgaucgcacuggacuaaucgagguugugcugcgaagcgacaccauagcuaacauucagcuuaauaaaucuaacauggccgcgacagccgcuuucaauaaggaugcacuccugaacugguugaaguccaaaaaucccggcgaagcccuggaccgggcuaucgaggaauuuacuuuaaguugcgccggguauuguguggcaaccuacguacucggaaucggugaucgucacagcgacaacauuaugaucagagagucuggccaacuguuccacauugauuuugggcauuuccuuggaaauuuuaagacaaaauucggcauaaacagggagcgcgucccauuuauccugaccuaugacuucgugcacguuauucagcaggguaagacuaauaacuccgaaaaauuugagcgguucagaggguacugcgaaagggcguacacgaucuugcgacgccauggccuccuguuucuacaccuguucgcccuuaugcgggcugccggacuccccgagcugucauguaguaaggacauccaauauuugaaggauagcuuagcacugggcaaaacagaagaggaggcucucaagcauuucagagugaaauuuaacgaagcccugagggagucguggaagaccaaagucaauuggcuugcacacaacguguccaaggacaaucgucaguga

SEQ ID NO: 9191 - RNA, 3135 nt, Artificial Sequence
  derived and/or modified sequence opt4 from PI3K__Homo_sapiens__AAI32920
augccccccggcguggacugccccauggaguucuggaccaaggaggagaaccagagcguggugguggacuuccugcugcccaccggcguguaccugaacuuccccgugagcagaaacgccaaccugagcaccaucaagcagcugcuguggcacagagcccaguacgagccccuguuccacaugcugagcggccccgaggccuacguguucaccugcaucaaccagaccgccgagcagcaggagcuggaggacgagcagagaagacugugcgacgugcagcccuuccugcccgugcugagacugguggccagagagggcgacagagugaagaagcugaucaacagccagaucagccugcugaucggcaagggccugcacgaguucgacagccugugcgaccccgaggugaacgacuucagagccaagaugugccaguucugcgaggaggccgccgccagaagacagcagcugggcugggaggccuggcugcaguacagcuucccccugcagcuggagcccagcgcccagaccuggggccccggcacccugagacugcccaacagagcccugcuggugaacgugaaguucgagggcagcgaggagagcuucaccuuccaggugagcaccaaggacgugccccuggcccugauggccugcgcccugagaaagaaggccaccguguucagacagccccugguggagcagcccgaggacuacacccugcaggugaacggcagacacgaguaccuguacggcagcuacccccugugccaguuccaguacaucugcagcugccugcacagcggccugaccccccaccugaccauggugcacagcagcagcauccuggccaugagagacgagcagagcaaccccgccccccaggugcagaagcccagagccaagcccccccccauccccgccaagaagcccagcagcgugagccuguggagccuggagcagcccuucagaaucgagcugauccagggcagcaaggugaacgccgacgagagaaugaagcugguggugcaggccggccuguuccacggcaacgagaugcugugcaagaccgugagcagcagcgaggugagcgugugcagcgagcccguguggaagcagagacuggaguucgacaucaacaucugcgaccugcccagaauggccagacugugcuucgcccuguacgccgugaucgagaaggccaagaaggccagaagcaccaagaagaagagcaagaaggccgacugccccaucgccugggccaaccugaugcuguucgacuacaaggaccagcugaagaccggcgagagaugccuguacauguggcccagcgugcccgacgagaagggcgagcugcugaaccccaccggcaccgugagaagcaaccccaacaccgacagcgccgccgcccugcugaucugccugcccgagguggccccccaccccguguacuaccccgcccuggagaagauccuggagcugggcagacacagcgagugcgugcacgugaccgaggaggagcagcugcagcugagagagauccuggagagaagaggcagcggcgagcuguacgagcacgagaaggaccugguguggaagcugagacacgaggugcaggagcacuuccccgaggcccuggccagacugcugcuggugaccaaguggaacaagcacgaggacguggcccagaugcuguaccugcugugcagcuggcccgagcugcccgugcugagcgcccuggagcugcuggacuucagcuuccccgacugccacgugggcagcuucgccaucaagagccugagaaagcugaccgacgacgagcuguuccaguaccugcugcagcuggugcaggugcugaaguacgagagcuaccuggacugcgagcugaccaaguuccugcuggacagagcccuggccaacagaaagaucggccacuuccuguucuggcaccugagaagcgagaugcacgugcccagcguggcccugagauucggccugauccuggaggccuacugcagaggcagcacccaccacaugaaggugcugaugaagcagggcgaggcccugagcaagcugaaggcccugaacgacuucgugaagcugagcagccagaagacccccaagccccagaccaaggagcugaugcaccugugcaugagacaggaggccuaccuggaggcccugagccaccugcagagcccccuggaccccagcacccugcuggccgaggugugcguggagcagugcaccuucauggacagcaagaugaagccccuguggaucauguacagcaacgaggaggccggcagcggcggcagcgugggcaucaucuucaagaacggcgacgaccugagacaggacaugcugacccugcagaugauccagcugauggacgugcuguggaagcaggagggccuggaccugagaaugacccccuacggcugccugcccaccggcgacagaaccggccugaucgagguggugcugagaagcgacaccaucgccaacauccagcugaacaagagcaacauggccgccaccgccgccuucaacaaggacgcccugcugaacuggcugaagagcaagaaccccggcgaggcccuggacagagccaucgaggaguucacccugagcugcgccggcuacugcguggccaccuacgugcugggcaucggcgacagacacagcgacaacaucaugaucagagagagcggccagcuguuccacaucgacuucggccacuuccugggcaacuucaagaccaaguucggcaucaacagagagagagugcccuucauccugaccuacgacuucgugcacgugauccagcagggcaagaccaacaacagcgagaaguucgagagauucagaggcuacugcgagagagccuacaccauccugagaagacacggccugcuguuccugcaccuguucgcccugaugagagccgccggccugcccgagcugagcugcagcaaggacauccaguaccugaaggacagccuggcccugggcaagaccgaggaggaggcccugaagcacuucagagugaaguucaacgaggcccugagagagagcuggaagaccaaggugaacuggcuggcccacaacgugagcaaggacaacagacaguga

SEQ ID NO: 9192 - RNA, 3135 nt, Artificial Sequence
  derived and/or modified sequence opt5 from PI3K__Homo_sapiens__AAI32920
augcccccuggcguggacugcccgauggaguucuggaccaaggaagagaaccagagcgucguuguggauuuucugcuccccacagggguguaccugaauuucccugucuccagaaacgccaaucuuucuacgaucaaacaacugcucuggcaccgggcucaguaugaaccccuguuucauaugcuuagcggaccugaggccuacguguucaccuguauuaaccagacagcggaacagcaagagcuggaggacgaacagcgcagacucugcgauguucagcccuuucugccugugcugcggcucgucgcucgcgagggcgacagagugaagaaacugaucaauucccagauuucucuucugaucgggaagggacuccacgaguucgauagccugugugacccggagguuaacgauuuucgggccaaaaugugccaauucugugaggaagccgcugcccgcagacagcagcuuggcugggaggcuuggcugcaguauuccuuuccccuccaacuggaaccuucugcccagaccugggggcccggaacacugcggcucccuaaucgcgcgcugcuugugaacgucaaguucgagggcagcgaagaguccuuuaccuuccaggugagcacaaaggacgugccccuggcccucauggcuugcgcccugagaaagaaggcuaccgucuuucggcaaccgcuuguugagcagccugaagauuacacgcuccaggugaauggccgccaugaguaucuguacgggucuuauccccugugucaguuccaauacauuugcuccugucugcacagcggacucaccccucaucugacaauggugcacucuuccagcauccuugccaugagagacgaacagucuaaccccgcgccccagguccagaaaccucgggccaagccgcccccuauccccgcuaaaaagccuuccagcgugucccuguggucucucgagcaacccuuccgcauugaacugauccagggcagcaagguuaaugccgaugagagaaugaaacuugugguccaggcugggcuguuucacggaaacgagaugcucugcaagaccguguccagcucugaaguuuccguguguagcgagccggucuggaaacagcggcuggaguucgacauuaauaucugcgaucugccuagaauggcccgccucugcuuugcccuguacgcugugauugaaaaggcgaaaaaggcccggucuacaaagaaaaagagcaaaaaggcugacugucccaucgccugggccaaccuuaugcuguucgacuauaaagaucaacucaagaccggcgaaagaugccuguacauguggccuuccguccccgacgagaaaggggagcugcuuaauccuacgggaacagugcgcucuaaccccaacaccgauagcgcugccgcgcuccugauuugucugccggaaguugcuccucaucccguguauuaccccgcccucgagaagauccuggaacuuggccggcacuccgagugcguccaugugacagaggaagaacagcugcagcucagagaaauccuggagcgccggggcagcggggaacuguaugagcacgagaaggaccuuguuuggaaacucagacacgaagugcaggagcauuuuccugaagcccuggcucgccugcuccuggucaccaaguggaauaaacacgaggauguggcccaaaugcuuuaccugcucuguucuuggccggaacugcccgugcuguccgcucuugagcuccuggacuucagcuuuccugauugccauguuggaucuuucgccauuaagucccugcggaaacucaccgacgaugagcuguuucaguaucuucugcagcucguccaagugcugaaguacgaaagcuaccuggacugugagcuuacaaaguuccuccuggauagagcgcuggccaaccgcaaaaucggccacuuucucuucuggcaucugcgguccgaaaugcacgugcccucugucgcucuuagauuugggcugauucucgaggccuauugccggggaagcacgcaccauaugaaggugcugaugaaacagggcgaagcucuguccaaacuuaaagcccugaaugacuucguuaagcucucuagccagaagaccccuaaaccccagacaaaggagcugaugcaccucuguaugcgccaagaggcguaccuggaagcccuuucccaucugcagagcccucucgaccccucuacccugcuggcugaggugugcgucgaacaguguacauucauggauuccaaaaugaagccgcuuuggaucauguauagcaacgaggaggccgggucuggaggcuccgugggcauuaucuuuaaaaauggggacgaucugagacaggacaugcucacccugcaaaugauccagcucauggauguucuguggaagcaggaaggacuugaccugcggaugacgccuuacggcugccuccccacaggggauagaaccggacugauugaggugguccugcgcagcgacaccaucgcuaacauucagcuuaauaaaucuaacauggccgccacagcugcguucaauaaggaugcccugcucaacuggcucaagagcaaaaauccuggcgaagcucuggaccgggccaucgaggaauuuacccuguccugcgccggguauuguguggcuacauacguucuuggcauuggagauagacacagcgacaacaucaugauccgcgagucuggccaacuguuccacauugauuuugggcauuuccugggaaauuuuaagacgaaauucggcaucaacagagagcgggugcccuuuauucucaccuaugacuucguccacgugauccagcaggggaagacaaauaacuccgaaaaauuugagcgcuucagaggauacugcgaacgggccuacaccauucugcgcagacauggccuucuguuucuccaccuguucgcgcucaugcgggcugccgggcugccggagcuuagcuguuccaaggacauccaauaucugaaggauucucuggcccucggcaaaacagaagaggaggcucugaagcauuuccgcgugaaauuuaacgaagcccuuagagagagcuggaagaccaaagucaauuggcuggcgcacaacguuuccaaggacaaucggcaguga

SEQ ID NO: 9193 - protein, 728 aa, Artificial Sequence
  PI3K__Homo_sapiens__O00459
MAGPEGFQYRALYPFRRERPEDLELLPGDVLVVSRAALQALGVAEGGERCPQSVGWMPGLNERTRQRGDFPGTYVEFLGPVALARPGPRPRGPRPLPARPRDGAPEPGLTLPDLPEQFSPPDVAPPLLVKLVEAIERTGLDSESHYRPELPAPRTDWSLSDVDQWDTAALADGIKSFLLALPAPLVTPEASAEARRALREAAGPVGPALEPPTLPLHRALTLRFLLQHLGRVASRAPALGPAVRALGATFGPLLLRAPPPPSSPPPGGAPDGSEPSPDFPALLVEKLLQEHLEEQEVAPPALPPKPPKAKPASTVLANGGSPPSLQDAEWYWGDISREEVNEKLRDTPDGTFLVRDASSKIQGEYTLTLRKGGNNKLIKVFHRDGHYGFSEPLTFCSVVDLINHYRHESLAQYNAKLDTRLLYPVSKYQQDQIVKEDSVEAVGAQLKVYHQQYQDKSREYDQLYEEYTRTSQELQMKRTAIEAFNETIKIFEEQGQTQEKCSKEYLERFRREGNEKEMQRILLNSERLKSRIAEIHESRTKLEQQLRAQASDNREIDKRMNSLKPDLMQLRKIRDQYLVWLTQKGARQKKINEWLGIKNETEDQYALMEDEDDLPHHEERTWYVGKINRTQAEEMLSGKRDGTFLIRESSQRGCYACSVVVDGDTKHCVIYRTATGFGFAEPYNLYGSLKELVLHYQHASLVQHNDALTVTLAHPVRAPGPGPPPAAR

SEQ ID NO: 9194 - RNA, 2187 nt, Artificial Sequence
  PI3K__Homo_sapiens__AAD22671
auggcgggcccugagggcuuccaguaccgcgcucuguacccguuccgccgggagcggccggaggaccuggagcugcugcccggcgacgugcugguagugagccgggcggccuugcaggcgcugggcguggccgaggguggcgagcgcugcccacagagcgugggcuggaugcccggccucaacgagcgcacacggcagcgaggugacuucccuggcaccuauguggaguuccuggggcccguggcccuggcccggcccggcccucgcccacggggcccccgcccacugcccgccaggccccgugauggggccccugagccaggccucacacuccccgacuugcccgagcaguucuccccaccugauguggcucccccucuucuggugaagcuuguggaggccauugaaaggacagggcuggacagcgaaucucacuaccgcccggagcugcccgcaccgcguacagacuggucccugagcgacguggaucagugggacacggcagcccuggcugacggcauuaagagcuuccugcuggcacugcccgcgccgcucgugacccccgaggccucggccgaggcgcgccgggcccugcgggaggccgcggggcccguggggccggcgcuggagccaccgacgcugccgcugcaccgcgcgcucacgcugcgcuuccugcuccagcaccugggccgcguggccagccgcgccccggcccugggucccgcgguccgggcccugggcgccaccuuugggccgcugcugcugcgcgcgccgccgccgccguccucgccgccgccagggggcgcucccgacgggagugagcccagcccugacuucccggcgcugcugguggagaagcugcuucaggaacacuuggaagagcaggagguugcgcccccagcgcugccgccuaaaccccccaaggcaaagccggccuccacaguccuggccaauggagggagcccacccucccugcaggaugcugagugguacuggggggacauuucaagggaggaggugaacgagaaacuccgggacacucccgauggcaccuuccuaguccgagaugcuucuagcaagauccagggcgaguacacgcugacccucaggaaaggcgggaacaauaagcugaucaaggucuuccaccgagaugggcacuauggcuucucagagccacucaccuucugcuccguuguggaccucaucaaucacuaccgccacgagucucuggcccaguacaaugccaagcuggacacacggcuccucuacccuguguccaaauaccagcaggaccagauugucaaggaggacagcguggaggcagugggcgcccagcuuaaggucuaucaccagcaguaccaggacaagagccgcgaguaugaccagcuuuaugaagaguacacacggaccucccaggagcugcagaugaagcguacugcaauugaggccuucaaugagacuaucaagaucuuugaagagcagggccagacucaagagaaaugcagcaaggaauaccuggagcgcuuccggcgugagggcaacgagaaagagaugcaaaggauccugcugaacuccgagcggcucaagucccgcauugccgagauccaugagagccgcacgaagcuggagcagcagcugcgggcccaggccucggacaacagagagaucgacaagcgcaugaacagccucaagccggaccucaugcagcugcgcaagauccgagaccaguaccucguguggcucacccagaaaggcgcccggcagaagaaaaucaacgaguggcuggggauuaaaaaugagacugaggaccaguacgcacucauggaggacgaggacgaucucccgcaccacgaggaacgcacuugguacgugggcaagaucaaccgcacgcaggcagaggagaugcugaguggcaagcgggauggcaccuuccucauccgcgagagcagccagcggggcugcuacgccugcuccgugguaguggacggcgacaccaagcacugcgucaucuaccgcacggccaccggcuucggcuucgcggagcccuacaaccuguacgggucgcugaaggagcuggugcugcacuaccagcacgccucgcuggugcagcacaacgacgcgcucaccgucacccuggcgcacccagugcgcgccccgggccccggcccgccgccugccgcccgcuga

SEQ ID NO: 9195 - RNA, 2187 nt, Artificial Sequence
  derived and/or modified sequence opt1 from PI3K__Homo_sapiens__AAD22671
auggccggccccgagggguuccaguaccgcgcccuguacccguuccggcgcgagcggcccgaggaccucgagcugcugcccggcgacgugcucgucgugagccgcgcggcccugcaggcccuggggguggccgagggcggggagcggugcccccaguccgucggcuggaugccgggccucaacgagcgcacccggcagcgcggggacuuccccggcaccuacguggaguuccuggggcccguggcccuggcgcggcccggcccgcgcccccgggggccccgcccccucccggcccggccccgcgacggcgcccccgagcccggccugacgcugccggaccuccccgagcaguucagcccccccgacgucgccccgccccugcuggugaagcucguggaggcgaucgagcggaccgggcuggacuccgagagccacuaccgccccgagcugcccgccccgcggaccgacuggucccucagcgacgucgaccagugggacaccgccgcccuggccgacggcaucaaguccuuccugcucgcgcugcccgccccccuggugacgcccgaggccagcgccgaggcccgccgggcgcuccgcgaggccgccgggccggugggccccgcccuggagcccccgacccugccccuccaccgggcccugacccugcgcuuccuccugcagcaccugggccgcgucgcgucccgggcccccgcccucgggcccgccgugcgcgcccugggcgcgaccuucgggccgcugcuccugcgggcccccccccccccgagcucccccccccccggcggggccccggacggcagcgagcccucccccgacuuccccgcccugcucguggagaagcugcugcaggagcaccucgaggagcaggaggucgcgccgcccgcccugccccccaagccgcccaaggccaagcccgccagcacggugcuggccaacggcgggucccccccgagccuccaggacgcggagugguacuggggcgacaucucccgcgaggaggugaacgagaagcugcgggacacccccgacgggaccuuccugguccgcgacgccagcuccaagauccagggcgaguacacccucacgcugcggaaggggggcaacaacaagcugaucaagguguuccaccgcgacggccacuacggguucagcgagccccugaccuucugcagcguggucgaccucaucaaccacuaccggcacgagucccuggcccaguacaacgccaagcuggacacccgccuccuguacccggugagcaaguaccagcaggaccagaucgugaaggaggacuccgucgaggccgugggcgcgcagcugaaggucuaccaccagcaguaccaggacaagagccgggaguacgaccagcucuacgaggaguacacccgcacgucccaggagcugcagaugaagcggaccgccaucgaggccuucaacgagaccaucaagaucuucgaggagcaggggcagacccaggagaagugcagcaaggaguaccuggagcgcuuccggcgcgagggcaacgagaaggagaugcagcggauccuccugaacuccgagcgccugaagagccggaucgccgagauccacgagucccgcacgaagcucgagcagcagcugcgcgcccaggcgagcgacaaccgggagaucgacaagcgcaugaacucccugaagcccgaccucaugcagcugcggaagauccgcgaccaguaccugguguggcucacccagaagggggcccggcagaagaagaucaacgaguggcugggcaucaagaacgagaccgaggaccaguacgcccugauggaggacgaggacgaccucccccaccacgaggagcgcaccugguacgugggcaagaucaaccggacgcaggccgaggagaugcugagcgggaagcgcgacggcaccuuccugauccgggaguccagccagcgcgggugcuacgcgugcuccgucgugguggacggcgacaccaagcacugcgucaucuaccggaccgccacgggcuucggguucgccgagcccuacaaccucuacggcagccugaaggagcuggugcuccacuaccagcacgccucccuggugcagcacaacgacgcccugaccgucacccucgcgcacccggugcgcgcccccgggcccggccccccgcccgccgcccgguga

SEQ ID NO: 9196 - RNA, 2187 nt, Artificial Sequence
  derived and/or modified sequence opt2 from PI3K__Homo_sapiens__AAD22671
auggccggccccgagggcuuccaguaccgcgcccucuaccccuuccgccgcgagcgccccgaggaccucgagcuccuccccggcgacguccucgucgucucccgcgccgcccuccaggcccucggcgucgccgagggcggcgagcgcugcccccaguccgucggcuggaugcccggccucaacgagcgcacccgccagcgcggcgacuuccccggcaccuacgucgaguuccucggccccgucgcccucgcccgccccggcccccgcccccgcggcccccgcccccuccccgcccgcccccgcgacggcgcccccgagcccggccucacccuccccgaccuccccgagcaguucuccccccccgacgucgcccccccccuccucgucaagcucgucgaggccaucgagcgcaccggccucgacuccgagucccacuaccgccccgagcuccccgccccccgcaccgacuggucccucuccgacgucgaccagugggacaccgccgcccucgccgacggcaucaaguccuuccuccucgcccuccccgccccccucgucacccccgaggccuccgccgaggcccgccgcgcccuccgcgaggccgccggccccgucggccccgcccucgagccccccacccucccccuccaccgcgcccucacccuccgcuuccuccuccagcaccucggccgcgucgccucccgcgcccccgcccucggccccgccguccgcgcccucggcgccaccuucggcccccuccuccuccgcgccccccccccccccuccucccccccccccggcggcgcccccgacggcuccgagcccucccccgacuuccccgcccuccucgucgagaagcuccuccaggagcaccucgaggagcaggaggucgccccccccgcccucccccccaagccccccaaggccaagcccgccuccaccguccucgccaacggcggcuccccccccucccuccaggacgccgagugguacuggggcgacaucucccgcgaggaggucaacgagaagcuccgcgacacccccgacggcaccuuccucguccgcgacgccuccuccaagauccagggcgaguacacccucacccuccgcaagggcggcaacaacaagcucaucaaggucuuccaccgcgacggccacuacggcuucuccgagccccucaccuucugcuccgucgucgaccucaucaaccacuaccgccacgagucccucgcccaguacaacgccaagcucgacacccgccuccucuaccccgucuccaaguaccagcaggaccagaucgucaaggaggacuccgucgaggccgucggcgcccagcucaaggucuaccaccagcaguaccaggacaagucccgcgaguacgaccagcucuacgaggaguacacccgcaccucccaggagcuccagaugaagcgcaccgccaucgaggccuucaacgagaccaucaagaucuucgaggagcagggccagacccaggagaagugcuccaaggaguaccucgagcgcuuccgccgcgagggcaacgagaaggagaugcagcgcauccuccucaacuccgagcgccucaagucccgcaucgccgagauccacgagucccgcaccaagcucgagcagcagcuccgcgcccaggccuccgacaaccgcgagaucgacaagcgcaugaacucccucaagcccgaccucaugcagcuccgcaagauccgcgaccaguaccucgucuggcucacccagaagggcgcccgccagaagaagaucaacgaguggcucggcaucaagaacgagaccgaggaccaguacgcccucauggaggacgaggacgaccucccccaccacgaggagcgcaccugguacgucggcaagaucaaccgcacccaggccgaggagaugcucuccggcaagcgcgacggcaccuuccucauccgcgaguccucccagcgcggcugcuacgccugcuccgucgucgucgacggcgacaccaagcacugcgucaucuaccgcaccgccaccggcuucggcuucgccgagcccuacaaccucuacggcucccucaaggagcucguccuccacuaccagcacgccucccucguccagcacaacgacgcccucaccgucacccucgcccaccccguccgcgcccccggccccggccccccccccgccgcccgcuga

SEQ ID NO: 9197 - RNA, 2187 nt, Artificial Sequence
  derived and/or modified sequence opt3 from PI3K__Homo_sapiens__AAD22671
auggccggccccgagggguuccaguacagagcucuguauccuuuuaggcgggaacgcccagaggaccucgaacuucugccgggagauguguuggucguuagccgagcagccuuacaagcgcuggguguggcugagggcggggaacguugcccccaguccguaggauggaugccuggccuaaacgagagaaccaggcagcggggugacuucccagggacauacguggaguuucucggacccgucgcccuggcacgcccuggcccaagacccaggggcccucggccacuuccggcccgcccccgagauggggcuccugaaccaggacugacuuugcccgaccucccugagcaguucucuccacccgauguggcaccgccucugcugguuaagcucguggaagccaucgagagaacggguuuagacucagagagucacuauaggcccgaacugccagcuccucggaccgauuggagccuuuccgacgucgaucaaugggacacagccgcguuggcagauggcauuaaaucuuuucugcuagcccuccccgcuccacuggugacucccgaggccucggcagaagcucgucgcgcccuuagagaggcggccgggccuguaggaccagcacuggaaccgcccaccuugccucuccauagggcucugacauuacgguuccugcuccagcaccuuggccgaguugccucacgcgcuccagcccugggucccgcagugagagccuugggggcuaccuuuggaccucuacugcucagggcgccacccccgccuagcaguccacccccuggcggcgcacccgacggguccgagccaucuccugauuuccccgcccugcuugucgagaagcuguugcaggaacaucucgaggaacaggagguggcuccaccggcccugccucccaaaccacccaaggcaaaaccugccagcacuguguuagcuaauggagguuccccacccucacugcaagacgccgaaugguacuggggcgacauaagucgggaggaggucaacgaaaagcuacgcgauacaccugacgggaccuuucucguuagagaugcaagcucuaagauccagggagaguauacgcugacucuuaggaaaggcgguaauaacaaguugauuaaaguguuccaccgugacgggcauuacggcuuuuccgaaccgcugaccuucuguucaguaguggaucucaucaaucacuaucggcacgagagccuggcgcaguacaacgcuaaacuugacacacgacuguuguacccagucaguaaguaucagcaagaucagauugugaaggaagacucuguugaggccgugggagcacagcucaaggucuaccaucaacaguaucaggauaaauccagagaguacgaccagcuguaugaagaguacacuaggaccagccaagaauuacagaugaagcgcacagccaucgaggcuuuuaaugagaccauaaaaaucuucgaagaacagggccagacgcaagaaaagugcucgaaagaguaucuggaacgguucagaagggaggggaacgagaaggaaaugcagcgcauucuacucaauucugagcgacugaaaucccggaucgccgaaauucacgagucacguacuaaacuugaacagcaguugagagcacaagcuagugauaacagggagaucgacaagcgcaugaauagccugaagcccgaccucaugcagcugcggaagauaagagaucaguacuuaguguggcugacacagaaaggagccaggcaaaagaaaauuaacgaguggcuugguaucaagaaugaaaccgaggaccaguacgcguugauggaagaugaggacgaucucccucaucacgaggagcgaacuugguauguaggcaagauuaaccgcacacaggccgaggaaaugcuguccgggaaacgggacggaaccuuucuaaucagagagucuagccaaaggggcuguuacgcuugcucaguuguggucgauggugacacgaagcacugugugaucuaucguaccgcaacaggguucggcuuugccgaaccauacaaucuguauggaagucucaaagagcugguccuucauuaccagcacgcuuccuuggugcagcauaacgaugcccugacuguuaccuuagcacaccccgugcgcgcgccuggcccggggcccccuccagccgcucgguga

SEQ ID NO: 9198 - RNA, 2187 nt, Artificial Sequence
  derived and/or modified sequence opt4 from PI3K__Homo_sapiens__AAD22671
auggccggccccgagggcuuccaguacagagcccuguaccccuucagaagagagagacccgaggaccuggagcugcugcccggcgacgugcugguggugagcagagccgcccugcaggcccugggcguggccgagggcggcgagagaugcccccagagcgugggcuggaugcccggccugaacgagagaaccagacagagaggcgacuuccccggcaccuacguggaguuccugggccccguggcccuggccagacccggccccagacccagaggccccagaccccugcccgccagacccagagacggcgcccccgagcccggccugacccugcccgaccugcccgagcaguucagcccccccgacguggcccccccccugcuggugaagcugguggaggccaucgagagaaccggccuggacagcgagagccacuacagacccgagcugcccgcccccagaaccgacuggagccugagcgacguggaccagugggacaccgccgcccuggccgacggcaucaagagcuuccugcuggcccugcccgccccccuggugacccccgaggccagcgccgaggccagaagagcccugagagaggccgccggccccgugggccccgcccuggagccccccacccugccccugcacagagcccugacccugagauuccugcugcagcaccugggcagaguggccagcagagcccccgcccugggccccgccgugagagcccugggcgccaccuucggcccccugcugcugagagccccccccccccccagcagccccccccccggcggcgcccccgacggcagcgagcccagccccgacuuccccgcccugcugguggagaagcugcugcaggagcaccuggaggagcaggagguggccccccccgcccugccccccaagccccccaaggccaagcccgccagcaccgugcuggccaacggcggcagcccccccagccugcaggacgccgagugguacuggggcgacaucagcagagaggaggugaacgagaagcugagagacacccccgacggcaccuuccuggugagagacgccagcagcaagauccagggcgaguacacccugacccugagaaagggcggcaacaacaagcugaucaagguguuccacagagacggccacuacggcuucagcgagccccugaccuucugcagcgugguggaccugaucaaccacuacagacacgagagccuggcccaguacaacgccaagcuggacaccagacugcuguaccccgugagcaaguaccagcaggaccagaucgugaaggaggacagcguggaggccgugggcgcccagcugaagguguaccaccagcaguaccaggacaagagcagagaguacgaccagcuguacgaggaguacaccagaaccagccaggagcugcagaugaagagaaccgccaucgaggccuucaacgagaccaucaagaucuucgaggagcagggccagacccaggagaagugcagcaaggaguaccuggagagauucagaagagagggcaacgagaaggagaugcagagaauccugcugaacagcgagagacugaagagcagaaucgccgagauccacgagagcagaaccaagcuggagcagcagcugagagcccaggccagcgacaacagagagaucgacaagagaaugaacagccugaagcccgaccugaugcagcugagaaagaucagagaccaguaccugguguggcugacccagaagggcgccagacagaagaagaucaacgaguggcugggcaucaagaacgagaccgaggaccaguacgcccugauggaggacgaggacgaccugccccaccacgaggagagaaccugguacgugggcaagaucaacagaacccaggccgaggagaugcugagcggcaagagagacggcaccuuccugaucagagagagcagccagagaggcugcuacgccugcagcguggugguggacggcgacaccaagcacugcgugaucuacagaaccgccaccggcuucggcuucgccgagcccuacaaccuguacggcagccugaaggagcuggugcugcacuaccagcacgccagccuggugcagcacaacgacgcccugaccgugacccuggcccaccccgugagagcccccggccccggccccccccccgccgccagauga

SEQ ID NO: 9199 - RNA, 2187 nt, Artificial Sequence
  derived and/or modified sequence opt5 from PI3K__Homo_sapiens__AAD22671
auggccggccccgagggguuccaguacagagcucuguauccuuuucggcgcgaaagaccggaggaccucgaacugcuucccggagaugugcuggucguuagccgggccgcgcuccaagcucugggcguggccgaagggggagaacgcugcccucaguccgugggcuggaugcccgggcuuaacgagagaacccggcagcgcggagacuucccuggcacauacgucgaguuucugggccccguggcccucgcuagaccugggccgcggccccgcggaccuagaccccugccugcccggccccgcgauggcgcuccggaaccugggcugacgcuccccgaccugccugagcaguucucuccucccgauguugccccuccgcuucuggugaagcucgucgaagcgaucgagagaaccggacuggacagcgagucccacuaucggcccgaacuuccugcuccccgcacagauuggucucugagcgacguggaucaaugggacaccgccgcccucgcugauggcauuaaauccuuucugcuggcccucccugcgccccugguuacaccggaggccucugcugaagccagacgggcucuuagagaggccgccgggccugugggacccgcucuggaaccucccacccucccucugcaucgcgcgcuuacacugcgguuccuccugcagcaccugggcagagucgccagccgcgcucccgcccucggcccggccgugcgggcucugggggccaccuuuggaccucuucugcucagagcgcccccgccucccuccucucccccucccggcggggcucccgacggaagcgagcccuccccugauuuccccgcccugcuuguggagaagcugcuccaggaacaucuggaggaacaggaggucgccccgccugcucugcccccuaaacccccgaaggccaaaccugcuagcacgguucucgccaauggcgggucucccccuucccugcaagacgcggaaugguacuggggagacaucagccgcgaggaggugaacgaaaagcugcgggauacccccgacggcacauuucuugugagagaugccucuuccaagauucagggcgaguauacccucacacugcgcaaagggggaaauaacaagcugaucaaagucuuccaccgggacggccauuacggguuuagcgaaccccuuaccuucuguuccgugguugaucucauuaaucacuauagacacgagucucuggcucaguacaacgccaagcuggacacgcgccuccuguacccugugagcaaauaucagcaagaucagaucgucaaggaagacuccguggaggcuguuggagcccagcuuaagguguaccaucaacaguaucaggauaaaagccgggaguacgaccagcuguaugaagaguacacaagaaccucucaagaacuccagaugaagcggacagcgaucgaggccuuuaaugagaccauuaaaaucuucgaggagcagggccagacccaagaaaagugcuccaaagaguaucuggaacgcuucagacgggaggggaacgagaaggaaaugcagcgcauucugcuuaauagcgagagacucaaaucucggaucgcugaaauucacgagagcagaacaaagcuggaacagcagcugcgcgcccaggcuuccgauaacagagagaucgacaagcggaugaacucucucaaaccggaccugaugcaacuucgcaagauuagagaucaguaccuggucuggcucacgcagaaaggcgcccggcaaaagaaaaucaaugaguggcugggaaucaagaaugaaaccgaggaccaguacgcccugauggaagaugaggacgaucuuccccaucacgaggaacgcacaugguaugugggcaagauuaacagaacccaggcugaggaaaugcucagcgggaaacgggacggaacauuucugauccgcgaguccagccaaagaggcuguuacgcgugcucugucgugguugauggggacaccaagcacugugugauuuaucggacggccacaggauucggcuuugcugaaccuuacaaucuguaugggucccucaaagagcugguccuucauuaccagcacgccagccuggugcagcauaacgaugcccucaccguuacccuggcucaccccgugcgcgccccuggccccggaccuccgcccgcggcuagauga

SEQ ID NO: 9200 - protein, 724 aa, Artificial Sequence
  PI3K__Homo_sapiens__P27986
MSAEGYQYRALYDYKKEREEDIDLHLGDILTVNKGSLVALGFSDGQEARPEEIGWLNGYNETTGERGDFPGTYVEYIGRKKISPPTPKPRPPRPLPVAPGSSKTEADVEQQALTLPDLAEQFAPPDIAPPLLIKLVEAIEKKGLECSTLYRTQSSSNLAELRQLLDCDTPSVDLEMIDVHVLADAFKRYLLDLPNPVIPAAVYSEMISLAPEVQSSEEYIQLLKKLIRSPSIPHQYWLTLQYLLKHFFKLSQTSSKNLLNARVLSEIFSPMLFRFSAASSDNTENLIKVIEILISTEWNERQPAPALPPKPPKPTTVANNGMNNNMSLQDAEWYWGDISREEVNEKLRDTADGTFLVRDASTKMHGDYTLTLRKGGNNKLIKIFHRDGKYGFSDPLTFSSVVELINHYRNESLAQYNPKLDVKLLYPVSKYQQDQVVKEDNIEAVGKKLHEYNTQFQEKSREYDRLYEEYTRTSQEIQMKRTAIEAFNETIKIFEEQCQTQERYSKEYIEKFKREGNEKEIQRIMHNYDKLKSRISEIIDSRRRLEEDLKKQAAEYREIDKRMNSIKPDLIQLRKTRDQYLMWLTQKGVRQKKLNEWLGNENTEDQYSLVEDDEDLPHHDEKTWNVGSSNRNKAENLLRGKRDGTFLVRESSKQGCYACSVVVDGEVKHCVINKTATGYGFAEPYNLYSSLKELVLHYQHTSLVQHNDSLNVTLAYPVYAQQRR

SEQ ID NO: 9201 - RNA, 2175 nt, Artificial Sequence
  PI3K__Homo_sapiens__AAH94795
augagugcugagggguaccaguacagagcgcuguaugauuauaaaaaggaaagagaagaagauauugacuugcacuugggugacauauugacugugaauaaaggguccuuaguagcucuuggauucagugauggacaggaagccaggccugaagaaauuggcugguuaaauggcuauaaugaaaccacaggggaaaggggggacuuuccgggaacuuacguagaauauauuggaaggaaaaaaaucucgccucccacaccaaagccccggccaccucggccucuuccuguugcaccagguucuucgaaaacugaagcagauguugaacaacaagcuuugacucucccggaucuugcagagcaguuugccccuccugacauugccccgccucuucuuaucaagcucguggaagccauugaaaagaaaggucuggaauguucaacucuauacagaacacagagcuccagcaaccuggcagaauuacgacagcuucuugauugugauacacccuccguggacuuggaaaugaucgaugugcacguuuuggcugacgcuuucaaacgcuaucuccuggacuuaccaaauccugucauuccagcagccguuuacagugaaaugauuucuuuagcuccagaaguacaaagcuccgaagaauauauucagcuauugaagaagcuuauuaggucgccuagcauaccucaucaguauuggcuuacgcuucaguauuuguuaaaacauuucuucaagcucucucaaaccuccagcaaaaaucuguugaaugcaagaguacucucugaaauuuucagcccuaugcuuuucagauucucagcagccagcucugauaauacugaaaaccucauaaaaguuauagaaauuuuaaucucaacugaauggaaugaacgacagccugcaccagcacugccuccuaaaccaccaaaaccuacuacuguagccaacaacgguaugaauaacaauauguccuuacaagaugcugaaugguacuggggagauaucucgagggaagaagugaaugaaaaacuucgagauacagcagacgggaccuuuuugguacgagaugcgucuacuaaaaugcauggugauuauacucuuacacuaaggaaagggggaaauaacaaauuaaucaaaauauuucaucgagaugggaaauauggcuucucugacccauuaaccuucaguucugugguugaauuaauaaaccacuaccggaaugaaucucuagcucaguauaaucccaaauuggaugugaaauuacuuuauccaguauccaaauaccaacaggaucaaguugucaaagaagauaauauugaagcuguagggaaaaaauuacaugaauauaacacucaguuucaagaaaaaagucgagaauaugauagauuauaugaagaauauacccgcacaucccaggaaauccaaaugaaaaggacagcuauugaagcauuuaaugaaaccauaaaaauauuugaagaacagugccagacccaagagcgguacagcaaagaauacauagaaaaguuuaaacgugaaggcaaugagaaagaaauacaaaggauuaugcauaauuaugauaaguugaagucucgaaucagugaaauuauugacaguagaagaagauuggaagaagacuugaagaagcaggcagcugaguaucgagaaauugacaaacguaugaacagcauuaaaccagaccuuauccagcugagaaagacgagagaccaauacuugaugugguugacucaaaaagguguucggcaaaagaaguugaacgagugguugggcaaugaaaacacugaagaccaauauucacugguggaagaugaugaagauuugccccaucaugaugagaagacauggaauguuggaagcagcaaccgaaacaaagcugaaaaccuguugcgagggaagcgagauggcacuuuucuuguccgggagagcaguaaacagggcugcuaugccugcucuguagugguggacggcgaaguaaagcauugugucauaaacaaaacagcaacuggcuauggcuuugccgagcccuauaacuuguacagcucucugaaagaacuggugcuacauuaccaacacaccucccuugugcagcacaacgacucccucaaugucacacuagccuacccaguauaugcacagcagaggcgauga

SEQ ID NO: 9202 - RNA, 2175 nt, Artificial Sequence
  derived and/or modified sequence opt1 from PI3K__Homo_sapiens__AAH94795
augagcgccgagggcuaccaguaccgcgcccuguacgacuacaagaaggagcgggaggaggacaucgaccuccaccugggggacauccugaccgugaacaagggcucccucgucgcgcugggguucagcgacggccaggaggcccgccccgaggagaucggguggcugaacggcuacaacgagaccacgggcgagcgcggggacuucccgggcaccuacguggaguacaucgggcggaagaagaucuccccgcccacccccaagccccggccgccccgcccccuccccguggcccccggcagcuccaagaccgaggccgacgucgagcagcaggcccugacgcugcccgaccucgcggagcaguucgcgcccccggacaucgccccgccccugcugaucaagcucguggaggccaucgagaagaaggggcuggagugcagcacccuguaccggacccaguccagcuccaaccucgccgagcugcgccagcugcucgacugcgacacccccagcguggaccuggagaugaucgacguccacgugcuggccgacgccuucaagcgguaccuccuggaccugcccaaccccgugauccccgccgccgucuacuccgagaugaucagccucgcgcccgaggugcaguccagcgaggaguacauccagcugcugaagaagcucauccgcuccccgagcaucccccaccaguacuggcugacgcugcaguaccuccugaagcacuucuucaagcugucccagaccagcuccaagaaccuccugaacgcccgggugcugagcgagaucuucagccccaugcuguuccgcuucuccgccgccagcuccgacaacaccgagaaccugaucaaggucaucgagauccugaucagcaccgaguggaacgagcggcagcccgccccggcgcucccgcccaagccgcccaagcccacgaccguggccaacaacggcaugaacaacaacaugucccugcaggacgccgagugguacuggggcgacaucagccgcgaggaggugaacgagaagcugcgggacaccgccgacgggaccuuccucguccgcgacgccuccacgaagaugcacggcgacuacacccugacccugcggaagggcgggaacaacaagcucaucaagaucuuccaccgcgacggcaaguacggguucagcgacccccugaccuucuccagcgugguggagcugaucaaccacuaccggaacgagucccucgcgcaguacaaccccaagcuggacgucaagcugcuguaccccgugagcaaguaccagcaggaccagguggucaaggaggacaacaucgaggccgugggcaagaagcuccacgaguacaacacgcaguuccaggagaagucccgcgaguacgaccggcuguacgaggaguacacccgcaccagccaggagauccagaugaagcgcaccgccaucgaggccuucaacgagacgaucaagaucuucgaggagcagugccagacccaggagcgguacuccaaggaguacaucgagaaguucaagcgcgaggggaacgagaaggagauccagcggaucaugcacaacuacgacaagcucaagagccgcaucuccgagaucaucgacagccggcgccggcucgaggaggaccugaagaagcaggccgcggaguaccgcgagaucgacaagcggaugaacuccaucaagcccgaccugauccagcuccgcaagacccgggaccaguaccugauguggcugacccagaagggcgugcgccagaagaagcucaacgaguggcuggggaacgagaacacggaggaccaguacagccuggucgaggacgacgaggaccucccccaccacgacgagaagaccuggaacgugggcagcuccaaccggaacaaggccgagaaccugcugcgcggcaagcgggacgggaccuuccucguccgcgagagcuccaagcagggcugcuacgccugcagcgugguggucgacggggaggugaagcacugcgugaucaacaagaccgccacgggcuacggguucgcggagccguacaaccuguacuccagccugaaggagcucguccugcacuaccagcacaccucccuggugcagcacaacgacagccucaacgugacccuggccuaccccgucuacgcccagcagcggcgcuga

SEQ ID NO: 9203 - RNA, 2175 nt, Artificial Sequence
  derived and/or modified sequence opt2 from PI3K__Homo_sapiens__AAH94795
auguccgccgagggcuaccaguaccgcgcccucuacgacuacaagaaggagcgcgaggaggacaucgaccuccaccucggcgacauccucaccgucaacaagggcucccucgucgcccucggcuucuccgacggccaggaggcccgccccgaggagaucggcuggcucaacggcuacaacgagaccaccggcgagcgcggcgacuuccccggcaccuacgucgaguacaucggccgcaagaagaucuccccccccacccccaagccccgccccccccgcccccuccccgucgcccccggcuccuccaagaccgaggccgacgucgagcagcaggcccucacccuccccgaccucgccgagcaguucgccccccccgacaucgcccccccccuccucaucaagcucgucgaggccaucgagaagaagggccucgagugcuccacccucuaccgcacccaguccuccuccaaccucgccgagcuccgccagcuccucgacugcgacacccccuccgucgaccucgagaugaucgacguccacguccucgccgacgccuucaagcgcuaccuccucgaccuccccaaccccgucauccccgccgccgucuacuccgagaugaucucccucgcccccgagguccaguccuccgaggaguacauccagcuccucaagaagcucauccgcucccccuccaucccccaccaguacuggcucacccuccaguaccuccucaagcacuucuucaagcucucccagaccuccuccaagaaccuccucaacgcccgcguccucuccgagaucuucucccccaugcucuuccgcuucuccgccgccuccuccgacaacaccgagaaccucaucaaggucaucgagauccucaucuccaccgaguggaacgagcgccagcccgcccccgcccucccccccaagccccccaagcccaccaccgucgccaacaacggcaugaacaacaacaugucccuccaggacgccgagugguacuggggcgacaucucccgcgaggaggucaacgagaagcuccgcgacaccgccgacggcaccuuccucguccgcgacgccuccaccaagaugcacggcgacuacacccucacccuccgcaagggcggcaacaacaagcucaucaagaucuuccaccgcgacggcaaguacggcuucuccgacccccucaccuucuccuccgucgucgagcucaucaaccacuaccgcaacgagucccucgcccaguacaaccccaagcucgacgucaagcuccucuaccccgucuccaaguaccagcaggaccaggucgucaaggaggacaacaucgaggccgucggcaagaagcuccacgaguacaacacccaguuccaggagaagucccgcgaguacgaccgccucuacgaggaguacacccgcaccucccaggagauccagaugaagcgcaccgccaucgaggccuucaacgagaccaucaagaucuucgaggagcagugccagacccaggagcgcuacuccaaggaguacaucgagaaguucaagcgcgagggcaacgagaaggagauccagcgcaucaugcacaacuacgacaagcucaagucccgcaucuccgagaucaucgacucccgccgccgccucgaggaggaccucaagaagcaggccgccgaguaccgcgagaucgacaagcgcaugaacuccaucaagcccgaccucauccagcuccgcaagacccgcgaccaguaccucauguggcucacccagaagggcguccgccagaagaagcucaacgaguggcucggcaacgagaacaccgaggaccaguacucccucgucgaggacgacgaggaccucccccaccacgacgagaagaccuggaacgucggcuccuccaaccgcaacaaggccgagaaccuccuccgcggcaagcgcgacggcaccuuccucguccgcgaguccuccaagcagggcugcuacgccugcuccgucgucgucgacggcgaggucaagcacugcgucaucaacaagaccgccaccggcuacggcuucgccgagcccuacaaccucuacuccucccucaaggagcucguccuccacuaccagcacaccucccucguccagcacaacgacucccucaacgucacccucgccuaccccgucuacgcccagcagcgccgcuga

SEQ ID NO: 9204 - RNA, 2175 nt, Artificial Sequence
  derived and/or modified sequence opt3 from PI3K__Homo_sapiens__AAH94795
augagcgccgagggcuaccaguauagagcucuguacgacuauaagaaagaaagggaggaagauaucgaccuccaccuuggggauauucugaccgugaacaagggauccuuggucgcauuagguuucucugacggccaagaggcccggcccgaagagauaggguggcugaauggauacaacgagacaacuggcgaacgcggugauuuuccugggacguauguugaguacaucggacgaaagaagauuucaccaccgacccccaaaccucguccacccagaccucuaccaguggcgcccggcaguagcaagacagaagcugacguagagcagcaggcccucacucugccugaucuugcagagcaguucgccccaccggacaucgcucccccucuguugauuaagcucguggaagcaaucgagaaaaagggccuggaaugcuccacccuguauaggacacaaucuucgucaaaucucgccgaguuacggcagcugcuugauugugacaccccaagcgucgauuuggaaaugauagacgugcauguucuggcugaugccuuuaaacgcuaccuacucgaccugcccaacccugugaucccagcggcagucuacagugagaugauuucccuugcccccgaggugcagucuagcgaagaguauauccagcuguugaagaaacucauuagauccccgucaaucccucaccaauacuggcugacuuuacaguaucugcucaagcauuucuuuaaacuuagucagacaagcucuaaaaaucuguugaacgcuaggguacuauccgaaauauucucacccaugcuguuucgguucagcgccgcaaguucugacaauaccgagaaccucauuaagguuaucgaaauucugaucuccacggaguggaaugagcgccagccagcuccugcccuucccccaaaacccccuaagccaacuaccguggcgaacaaugggaugaacaauaacaugagccugcaagaugccgaaugguacuggggagacaucucgcgagaggaagucaaugagaaauugagagauacagcagacgguacuuuucucgugagggaugcuucuaccaagaugcacggcgacuauacacugaccuuacggaaagggggaaacaacaagcugauuaagauauuccaucgugauggcaaauacgguuuuuccgacccgcuaacguucucaaguguggucgaacucaucaaucacuaucgcaacgagagccuggcccaguacaaucccaaacuugauguuaaguugcuguacccuguguccaaguaucagcaagaccagguagugaaagaggauaacauugaagcugucgggaagaagcuccacgaguacaauacucaguuucaggaaaaaucuagagaguaugacaggcuguacgaggaauauacacggaccagccaagagauccagaugaagcgaacugccauagaagcauucaacgagacaauuaaaaucuucgaggaacagugccagacccaagagcgcuacucaaaggaauauaucgagaaauuuaagagagaaggaaaugagaaggaaauucagaggaucaugcauaacuacgacaaacuuaagagucggauuuccgagauaaucgauagccgcagaaggcuggaggaagacuugaaaaagcaggccgcugaguaccgugaaauugauaaacggaugaacucuaucaagccagaccucauccagcugcgaaagacgagagaucaauauuuaauguggcugacccagaaaggcgugaggcagaagaaacuaaaugaguggcucggcaaugaaaacacagaggaccaguacucacugguugaggaugacgaagaucuuccccaccaugacgagaagacuuggaauguggggaguagcaaccgcaauaaagcggaaaacuugcugcggggaaagagagaugguaccuuccucgucagggaguccucuaaacaaggcuguuaugcaugcucggugguaguugacggggaggugaagcacugugucauuaacaagacagccacuggauacggcuuugcugaaccuuauaaucuguacagcuccuuaaaagagcuggugcuucacuaucagcauaccucauugguccagcacaacgauagucucaaugugacacuggccuacccaguuuacgcacaacagcgccgauga

SEQ ID NO: 9205 - RNA, 2175 nt, Artificial Sequence
  derived and/or modified sequence opt4 from PI3K__Homo_sapiens__AAH94795
augagcgccgagggcuaccaguacagagcccuguacgacuacaagaaggagagagaggaggacaucgaccugcaccugggcgacauccugaccgugaacaagggcagccugguggcccugggcuucagcgacggccaggaggccagacccgaggagaucggcuggcugaacggcuacaacgagaccaccggcgagagaggcgacuuccccggcaccuacguggaguacaucggcagaaagaagaucagcccccccacccccaagcccagaccccccagaccccugcccguggcccccggcagcagcaagaccgaggccgacguggagcagcaggcccugacccugcccgaccuggccgagcaguucgccccccccgacaucgcccccccccugcugaucaagcugguggaggccaucgagaagaagggccuggagugcagcacccuguacagaacccagagcagcagcaaccuggccgagcugagacagcugcuggacugcgacacccccagcguggaccuggagaugaucgacgugcacgugcuggccgacgccuucaagagauaccugcuggaccugcccaaccccgugauccccgccgccguguacagcgagaugaucagccuggcccccgaggugcagagcagcgaggaguacauccagcugcugaagaagcugaucagaagccccagcaucccccaccaguacuggcugacccugcaguaccugcugaagcacuucuucaagcugagccagaccagcagcaagaaccugcugaacgccagagugcugagcgagaucuucagccccaugcuguucagauucagcgccgccagcagcgacaacaccgagaaccugaucaaggugaucgagauccugaucagcaccgaguggaacgagagacagcccgcccccgcccugccccccaagccccccaagcccaccaccguggccaacaacggcaugaacaacaacaugagccugcaggacgccgagugguacuggggcgacaucagcagagaggaggugaacgagaagcugagagacaccgccgacggcaccuuccuggugagagacgccagcaccaagaugcacggcgacuacacccugacccugagaaagggcggcaacaacaagcugaucaagaucuuccacagagacggcaaguacggcuucagcgacccccugaccuucagcagcgugguggagcugaucaaccacuacagaaacgagagccuggcccaguacaaccccaagcuggacgugaagcugcuguaccccgugagcaaguaccagcaggaccagguggugaaggaggacaacaucgaggccgugggcaagaagcugcacgaguacaacacccaguuccaggagaagagcagagaguacgacagacuguacgaggaguacaccagaaccagccaggagauccagaugaagagaaccgccaucgaggccuucaacgagaccaucaagaucuucgaggagcagugccagacccaggagagauacagcaaggaguacaucgagaaguucaagagagagggcaacgagaaggagauccagagaaucaugcacaacuacgacaagcugaagagcagaaucagcgagaucaucgacagcagaagaagacuggaggaggaccugaagaagcaggccgccgaguacagagagaucgacaagagaaugaacagcaucaagcccgaccugauccagcugagaaagaccagagaccaguaccugauguggcugacccagaagggcgugagacagaagaagcugaacgaguggcugggcaacgagaacaccgaggaccaguacagccugguggaggacgacgaggaccugccccaccacgacgagaagaccuggaacgugggcagcagcaacagaaacaaggccgagaaccugcugagaggcaagagagacggcaccuuccuggugagagagagcagcaagcagggcugcuacgccugcagcguggugguggacggcgaggugaagcacugcgugaucaacaagaccgccaccggcuacggcuucgccgagcccuacaaccuguacagcagccugaaggagcuggugcugcacuaccagcacaccagccuggugcagcacaacgacagccugaacgugacccuggccuaccccguguacgcccagcagagaagauga

SEQ ID NO: 9206 - RNA, 2175 nt, Artificial Sequence
  derived and/or modified sequence opt5 from PI3K__Homo_sapiens__AAH94795
augagcgccgagggcuaccaguauagagcucuguacgacuauaagaaagaacgggaggaagauaucgaccuccaccugggggauauucuuaccgugaacaagggaucccuggucgcccucggcuucucugacgggcaagaggcgcgccccgaagagaucggauggcugaauggcuacaacgagacaacgggggaaagaggagauuuuccuggcaccuauguugaguacauuggccggaaaaagaucagcccgcccacaccuaaaccccgcccucccagaccucuuccgguggcucccggguccucuaagaccgaagccgacguggagcagcaggcccugacacucccugaucuggcugagcaguucgcucccccugacauugcucccccgcugcucaucaagcuggucgaagccaucgagaaaaagggacuugaaugcagcacccuguaucggacacaauccucuagcaaucucgcggagcugcgccagcuucuggauugugacaccccuuccguggaucucgaaaugauugacguucaugugcuggccgaugcuuuuaaaagauaccugcucgaccugcccaacccugucauccccgccgcuguguacagcgagaugauuucucuugcccccgagguucaguccagcgaagaguauauccagcugcucaagaaacugauucggucuccuuccaucccgcaccaauacuggcuuacgcugcaguaucuccugaagcauuucuuuaagcugagccagaccucuuccaaaaaucuccugaacgcgcgcgugcuuagcgaaauuuucucccccaugcuguuuagauucucugccgcuagcuccgacaauacagagaaccucaucaaggucaucgaaauucugaucagcaccgaguggaaugagcggcagccugcccccgcccuuccucccaaaccgccuaagcccacaaccguggccaacaauggcaugaacaauaacaugucucugcaagaugccgaaugguacuggggagacauuucccgcgaggaagugaaugagaaacucagagauacggcugacgggacauuucugguccgggaugcgagcaccaagaugcacggcgacuauacacugacccuccgcaaagggggaaacaacaagcugaucaagauuuuccauagagauggcaaauacggcuuuucugacccucuuaccuucagcuccguuguggaacugaucaaucacuaucggaacgagucucucgcccaguacaaucccaagcuggaugugaaacugcuuuacccugucagcaaguaucagcaagaccaggugguuaaagaggauaacaucgaagcuguggggaagaagcuccacgaguacaauacacaguuucaggaaaaauccagagaguaugaccgccuguacgaggaauauacgcggaccagccaagagauucagaugaagagaacagccaucgaagccuucaacgagaccauuaaaaucuucgaggaacagugccagacacaagagcgcuacucuaaggaauauauugagaaauuuaagcgggaaggaaaugagaaggaaauccagagaaucaugcauaacuacgacaaacugaagucccgcauuagcgagaucauugauucucggagacgccucgaggaagaccugaaaaagcaggcugccgaguaccgggaaaucgauaaaagaaugaacuccauuaagcccgaccuuauccagcugcgcaagacccgggaucaauaucucauguggcugacgcagaaaggcgucagacagaagaaacugaaugaguggcuugggaaugaaaacacagaggaccaguacagccucguggaggaugacgaagaucugccgcaccaugacgagaagaccuggaauguuggauccucuaaccggaauaaagcggaaaaccugcuccgcggcaagagagaugggaccuuccuggugcgggagagcuccaaacaaggauguuaugcuugcucugucguggucgacggcgaggugaagcacuguguuauuaacaagacagccaccggcuacggguuugccgaaccuuauaaucuuuacagcucccugaaagagcucgugcugcacuaucagcauacaagccugguccagcacaacgauucucuuaaugugacgcucgcuuaccccguuuacgcccaacagagacgcuga

SEQ ID NO: 9207 - protein, 1068 aa, Artificial Sequence
  PI3K__Homo_sapiens__P42336
MPPRPSSGELWGIHLMPPRILVECLLPNGMIVTLECLREATLITIKHELFKEARKYPLHQLLQDESSYIFVSVTQEAEREEFFDETRRLCDLRLFQPFLKVIEPVGNREEKILNREIGFAIGMPVCEFDMVKDPEVQDFRRNILNVCKEAVDLRDLNSPHSRAMYVYPPNVESSPELPKHIYNKLDKGQIIVVIWVIVSPNNDKQKYTLKINHDCVPEQVIAEAIRKKTRSMLLSSEQLKLCVLEYQGKYILKVCGCDEYFLEKYPLSQYKYIRSCIMLGRMPNLMLMAKESLYSQLPMDCFTMPSYSRRISTATPYMNGETSTKSLWVINSALRIKILCATYVNVNIRDIDKIYVRTGIYHGGEPLCDNVNTQRVPCSNPRWNEWLNYDIYIPDLPRAARLCLSICSVKGRKGAKEEHCPLAWGNINLFDYTDTLVSGKMALNLWPVPHGLEDLLNPIGVTGSNPNKETPCLELEFDWFSSVVKFPDMSVIEEHANWSVSREAGFSYSHAGLSNRLARDNELRENDKEQLKAISTRDPLSEITEQEKDFLWSHRHYCVTIPEILPKLLLSVKWNSRDEVAQMYCLVKDWPPIKPEQAMELLDCNYPDPMVRGFAVRCLEKYLTDDKLSQYLIQLVQVLKYEQYLDNLLVRFLLKKALTNQRIGHFFFWHLKSEMHNKTVSQRFGLLLESYCRACGMYLKHLNRQVEAMEKLINLTDILKQEKKDETQKVQMKFLVEQMRRPDFMDALQGFLSPLNPAHQLGNLRLEECRIMSSAKRPLWLNWENPDIMSELLFQNNEIIFKNGDDLRQDMLTLQIIRIMENIWQNQGLDLRMLPYGCLSIGDCVGLIEVVRNSHTIMQIQCKGGLKGALQFNSHTLHQWLKDKNKGEIYDAAIDLFTRSCAGYCVATFILGIGDRHNSNIMVKDDGQLFHIDFGHFLDHKKKKFGYKRERVPFVLTQDFLIVISKGAQECTKTREFERFQEMCYKAYLAIRQHANLFINLFSMMLGSGMPELQSFDDIAYIRKTLALDKTEQEALEYFMKQMNDAHHGGWTTKMDWIFHTIKQHALN

SEQ ID NO: 9208 - RNA, 3207 nt, Artificial Sequence
  PI3K__Homo_sapiens__AAB39753
augccuccaagaccaucaucaggugaacuguggggcauccacuugaugcccccaagaauccuaguagaauguuuacuaccaaauggaaugauagugacuuuagaaugccuccgugaggcuacauuaauaaccauaaagcaugaacuauuuaaagaagcaagaaaauacccccuccaucaacuucuucaagaugaaucuucuuacauuuucguaaguguuacccaagaagcagaaagggaagaauuuuuugaugaaacaagacgacuuugugaccuucggcuuuuucaacccuuuuuaaaaguaauugaaccaguaggcaaccgugaagaaaagauccucaaucgagaaauugguuuugcuaucggcaugccagugugugaauuugauaugguuaaagauccagaaguacaggacuuccgaagaaauauucugaacguuuguaaagaagcuguggaucuuagggaccucaauucaccucauaguagagcaauguaugucuauccuccaaauguagaaucuucaccagaauugccaaagcacauauauaauaaauuagauaaagggcaaauaauaguggugaucuggguaauaguuucuccaaauaaugacaagcagaaguauacucugaaaaucaaccaugacuguguaccagaacaaguaauugcugaagcaaucaggaaaaaaacucgaaguauguugcuauccucugaacaacuaaaacucuguguuuuagaauaucagggcaaguauauuuuaaaaguguguggaugugaugaauacuuccuagaaaaauauccucugagucaguauaaguauauaagaagcuguauaaugcuugggaggaugcccaauuugauguugauggcuaaagaaagccucuauucucaacugccaauggacuguuuuacaaugccaucuuauuccagacgcauuuccacagcuacaccauauaugaauggagaaacaucuacaaaaucccuuuggguuauaaauagugcacucagaauaaaaauucuuugugcaaccuacgugaauguaaauauucgagacauugauaagaucuauguucgaacagguaucuaccauggaggagaacccuuaugugacaaugugaacacucaaagaguaccuuguuccaaucccagguggaaugaauggcugaauuaugauauauacauuccugaucuuccucgugcugcucgacuuugccuuuccauuugcucuguuaaaggccgaaagggugcuaaagaggaacacuguccauuggcauggggaaauauaaacuuguuugauuacacagacacucuaguaucuggaaaaauggcuuugaaucuuuggccaguaccucauggacuagaagauuugcugaacccuauugguguuacuggaucaaauccaaauaaagaaacuccaugcuuagaguuggaguuugacugguucagcagugugguaaaguucccagauaugucagugauugaagagcaugccaauuggucuguaucccgagaagcaggauuuagcuauucccacgcaggacugaguaacagacuagcuagagacaaugaauuaagggaaaaugacaaagaacagcucaaagcaauuucuacacgagauccucucucugaaaucacugagcaggagaaagauuuucuauggagucacagacacuauuguguaacuauccccgaaauucuacccaaauugcuucugucuguuaaauggaauucuagagaugaaguagcccagauguauugcuugguaaaagauuggccuccaaucaaaccugaacaggcuauggaacuucuggacuguaauuacccagauccuaugguucgagguuuugcuguucggugcuuggaaaaauauuuaacagaugacaaacuuucucaguauuuaauucagcuaguacagguccuaaaauaugaacaauauuuggauaacuugcuugugagauuuuuacugaagaaagcauugacuaaucaaaggauugggcacuuuuucuuuuggcauuuaaaaucugagaugcacaauaaaacaguuagccagagguuuggccugcuuuuggaguccuauugucgugcaugugggauguauuugaagcaccugaauaggcaagucgaggcaauggaaaagcucauuaacuuaacugacauucucaaacaggagaagaaggaugaaacacaaaagguacagaugaaguuuuuaguugagcaaaugaggcgaccagauuucauggaugcucuacagggcuuucugucuccucuaaacccugcucaucaacuaggaaaccucaggcuugaagagugucgaauuauguccucugcaaaaaggccacugugguugaauugggagaacccagacaucaugucagaguuacuguuucagaacaaugagaucaucuuuaaaaauggggaugauuuacggcaagauaugcuaacacuucaaauuauucguauuauggaaaauaucuggcaaaaucaaggucuugaucuucgaauguuaccuuaugguugucugucaaucggugacugugugggacuuauugagguggugcgaaauucucacacuauuaugcaaauucagugcaaaggcggcuugaaaggugcacugcaguucaacagccacacacuacaucaguggcucaaagacaagaacaaaggagaaauauaugaugcagccauugaccuguuuacacguucaugugcuggauacuguguagcuaccuucauuuugggaauuggagaucgucacaauaguaacaucauggugaaagacgauggacagcuguuucauauagauuuuggacacuuuuuggaucacaagaagaaaaaauuugguuauaaacgagaacgugugccauuuguuuugacacaggauuucuuaauagugauuaguaaaggagcccaagaaugcacaaagacaagagaauuugagagguuucaggagauguguuacaaggcuuaucuagcuauucgacagcaugccaaucucuucauaaaucuuuucucaaugaugcuuggcucuggaaugccagaacuacaaucuuuugaugacauugcauacauucgaaagacccuagccuuagauaaaacugagcaagaggcuuuggaguauuucaugaaacaaaugaaugaugcacaucaugguggcuggacaacaaaaauggauuggaucuuccacacaauuaaacagcaugcauugaacuga

SEQ ID NO: 9209 - RNA, 3207 nt, Artificial Sequence
  derived and/or modified sequence opt1 from PI3K__Homo_sapiens__AAB39753
augcccccgcgccccagcuccggcgagcugugggggauccaccucaugccgccccggauccugguggagugccugcuccccaacggcaugaucgucacccuggagugccugcgcgaggccacccucaucacgaucaagcacgagcuguucaaggaggcccggaaguacccccugcaccagcuccugcaggacgagagcuccuacaucuucgugagcgugacccaggaggcggagcgcgaggaguucuucgacgagacccggcgccugugcgaccuccggcuguuccagcccuuccugaaggucaucgagcccguggggaaccgcgaggagaagauccucaaccgggagaucggcuucgccaucgggaugccggugugcgaguucgacauggucaaggaccccgaggugcaggacuuccgccggaacauccugaacgugugcaaggaggccgucgaccugcgcgaccucaacagcccccacagccgggccauguacguguacccgcccaacguggaguccagccccgagcugcccaagcacaucuacaacaagcuggacaagggccagaucaucgucgugaucugggugaucgucucccccaacaacgacaagcagaaguacacccucaagaucaaccacgacugcgugccggagcaggucaucgccgaggcgauccgcaagaagacgcggagcaugcugcuguccagcgagcagcucaagcugugcgugcuggaguaccagggcaaguacauccucaaggugugcgggugcgacgaguacuuccuggagaaguacccccugucccaguacaaguacauccgcagcugcaucaugcucggccggaugcccaaccugaugcugauggccaaggagucccucuacagccagcugcccauggacugcuucaccaugccguccuacagccgccggaucuccaccgccacccccuacaugaacggggagacgagcaccaagagccugugggugaucaacuccgcccuccgcaucaagauccugugcgcgaccuacgucaacgugaacauccgggacaucgacaagaucuacgugcgcaccggcaucuaccacgggggcgagccccugugcgacaacgucaacacgcagcgcgugcccugcagcaacccgcgguggaacgaguggcucaacuacgacaucuacauccccgaccugccccgcgccgcccggcugugccucuccaucugcagcgucaagggccgcaagggggccaaggaggagcacugcccccuggccuggggcaacaucaaccuguucgacuacaccgacacccucguguccgggaagauggcgcugaaccuguggccggugccccacggccucgaggaccugcugaaccccaucggcgucaccgggagcaacccgaacaaggagacgcccugccuggagcucgaguucgacugguucuccagcguggugaaguuccccgacauguccgucaucgaggagcacgccaacuggagcgugucccgggaggccggcuucagcuacucccacgccgggcugagcaaccgccuggcccgggacaacgagcuccgcgagaacgacaaggagcagcugaaggcgaucuccacccgggacccccugagcgagaucaccgagcaggagaaggacuuccucuggucccaccgccacuacugcgugaccaucccggagauccugcccaagcugcuccugagcgucaaguggaacucccgggacgagguggcccagauguacugccuggugaaggacuggccgcccaucaagcccgagcaggccauggagcuccuggacugcaacuaccccgaccccaugguccgcggcuucgccgugcggugccuggagaaguaccucacggacgacaagcugagccaguaccugauccagcucgugcagguccugaaguacgagcaguaccuggacaaccuccuggugcgcuuccugcucaagaaggcccugaccaaccagcggaucgggcacuucuucuucuggcaccugaaguccgagaugcacaacaagaccgugucccagcgcuucggccuccugcuggagagcuacugccgggcgugcggcauguaccucaagcaccugaaccgccaggucgaggccauggagaagcugaucaaccucaccgacauccugaagcaggagaagaaggacgagacgcagaaggugcagaugaaguuccugguggagcagaugcggcgccccgacuucauggacgcccuccagggguuccuguccccgcugaaccccgcccaccagcucggcaaccugcgccuggaggagugccggaucaugagcuccgccaagcgcccccucuggcugaacugggagaaccccgacaucaugagcgagcuccucuuccagaacaacgagaucaucuucaagaacggggacgaccugcggcaggacaugcugacccuccagaucauccgcaucauggagaacaucuggcagaaccagggccuggaccugcggaugcucccguacgggugccuguccaucggcgacugcgucggccugaucgagguggugcgcaacagccacaccaucaugcagauccagugcaagggcgggcucaagggggcgcugcaguucaacucccacacccugcaccaguggcucaaggacaagaacaagggcgagaucuacgacgccgccaucgaccuguucacgcggagcugcgccggguacugcgucgcgaccuucauccugggcaucggcgaccgccacaacuccaacaucauggugaaggacgacgggcagcuguuccacaucgacuucggccacuuccuggaccacaagaagaagaaguucggguacaagcgggagcgcgugcccuucguccugacccaggacuuccucaucgugaucagcaagggcgcccaggagugcaccaagacgcgggaguucgagcgcuuccaggagaugugcuacaaggccuaccuggccauccggcagcacgccaaccuguucaucaaccucuucuccaugaugcugggcagcgggaugcccgagcugcaguccuucgacgacaucgcguacauccgcaagacccucgcccuggacaagaccgagcaggaggcccuggaguacuucaugaagcagaugaacgacgcccaccacggcggguggaccacgaagauggacuggaucuuccacaccaucaagcagcacgcccucaacuga

SEQ ID NO: 9210 - RNA, 3207 nt, Artificial Sequence
  derived and/or modified sequence opt2 from PI3K__Homo_sapiens__AAB39753
augcccccccgccccuccuccggcgagcucuggggcauccaccucaugcccccccgcauccucgucgagugccuccuccccaacggcaugaucgucacccucgagugccuccgcgaggccacccucaucaccaucaagcacgagcucuucaaggaggcccgcaaguacccccuccaccagcuccuccaggacgaguccuccuacaucuucgucuccgucacccaggaggccgagcgcgaggaguucuucgacgagacccgccgccucugcgaccuccgccucuuccagcccuuccucaaggucaucgagcccgucggcaaccgcgaggagaagauccucaaccgcgagaucggcuucgccaucggcaugcccgucugcgaguucgacauggucaaggaccccgagguccaggacuuccgccgcaacauccucaacgucugcaaggaggccgucgaccuccgcgaccucaacuccccccacucccgcgccauguacgucuacccccccaacgucgaguccucccccgagcuccccaagcacaucuacaacaagcucgacaagggccagaucaucgucgucaucugggucaucgucucccccaacaacgacaagcagaaguacacccucaagaucaaccacgacugcguccccgagcaggucaucgccgaggccauccgcaagaagacccgcuccaugcuccucuccuccgagcagcucaagcucugcguccucgaguaccagggcaaguacauccucaaggucugcggcugcgacgaguacuuccucgagaaguacccccucucccaguacaaguacauccgcuccugcaucaugcucggccgcaugcccaaccucaugcucauggccaaggagucccucuacucccagcuccccauggacugcuucaccaugcccuccuacucccgccgcaucuccaccgccacccccuacaugaacggcgagaccuccaccaagucccucugggucaucaacuccgcccuccgcaucaagauccucugcgccaccuacgucaacgucaacauccgcgacaucgacaagaucuacguccgcaccggcaucuaccacggcggcgagccccucugcgacaacgucaacacccagcgcguccccugcuccaacccccgcuggaacgaguggcucaacuacgacaucuacauccccgaccucccccgcgccgcccgccucugccucuccaucugcuccgucaagggccgcaagggcgccaaggaggagcacugcccccucgccuggggcaacaucaaccucuucgacuacaccgacacccucgucuccggcaagauggcccucaaccucuggcccgucccccacggccucgaggaccuccucaaccccaucggcgucaccggcuccaaccccaacaaggagacccccugccucgagcucgaguucgacugguucuccuccgucgucaaguuccccgacauguccgucaucgaggagcacgccaacugguccgucucccgcgaggccggcuucuccuacucccacgccggccucuccaaccgccucgcccgcgacaacgagcuccgcgagaacgacaaggagcagcucaaggccaucuccacccgcgacccccucuccgagaucaccgagcaggagaaggacuuccucuggucccaccgccacuacugcgucaccauccccgagauccuccccaagcuccuccucuccgucaaguggaacucccgcgacgaggucgcccagauguacugccucgucaaggacuggccccccaucaagcccgagcaggccauggagcuccucgacugcaacuaccccgaccccaugguccgcggcuucgccguccgcugccucgagaaguaccucaccgacgacaagcucucccaguaccucauccagcucguccagguccucaaguacgagcaguaccucgacaaccuccucguccgcuuccuccucaagaaggcccucaccaaccagcgcaucggccacuucuucuucuggcaccucaaguccgagaugcacaacaagaccgucucccagcgcuucggccuccuccucgaguccuacugccgcgccugcggcauguaccucaagcaccucaaccgccaggucgaggccauggagaagcucaucaaccucaccgacauccucaagcaggagaagaaggacgagacccagaagguccagaugaaguuccucgucgagcagaugcgccgccccgacuucauggacgcccuccagggcuuccucuccccccucaaccccgcccaccagcucggcaaccuccgccucgaggagugccgcaucauguccuccgccaagcgcccccucuggcucaacugggagaaccccgacaucauguccgagcuccucuuccagaacaacgagaucaucuucaagaacggcgacgaccuccgccaggacaugcucacccuccagaucauccgcaucauggagaacaucuggcagaaccagggccucgaccuccgcaugcuccccuacggcugccucuccaucggcgacugcgucggccucaucgaggucguccgcaacucccacaccaucaugcagauccagugcaagggcggccucaagggcgcccuccaguucaacucccacacccuccaccaguggcucaaggacaagaacaagggcgagaucuacgacgccgccaucgaccucuucacccgcuccugcgccggcuacugcgucgccaccuucauccucggcaucggcgaccgccacaacuccaacaucauggucaaggacgacggccagcucuuccacaucgacuucggccacuuccucgaccacaagaagaagaaguucggcuacaagcgcgagcgcguccccuucguccucacccaggacuuccucaucgucaucuccaagggcgcccaggagugcaccaagacccgcgaguucgagcgcuuccaggagaugugcuacaaggccuaccucgccauccgccagcacgccaaccucuucaucaaccucuucuccaugaugcucggcuccggcaugcccgagcuccaguccuucgacgacaucgccuacauccgcaagacccucgcccucgacaagaccgagcaggaggcccucgaguacuucaugaagcagaugaacgacgcccaccacggcggcuggaccaccaagauggacuggaucuuccacaccaucaagcagcacgcccucaacuga

SEQ ID NO: 9211 - RNA, 3207 nt, Artificial Sequence
  derived and/or modified sequence opt3 from PI3K__Homo_sapiens__AAB39753
augcccccuagaccaagcuccggcgagcugugggggauccaccucaugccgcccaggauucuuguggaaugccuguugccuaacggaaugauagucaccuuagagugucugcgggaagccacacuaaucacuauuaagcaugaacucuucaaagaagcucgcaaguacccacugcaccagcuucugcaagacgagucuucauauaucuuuguuagugugacgcaggaggcagaacgagaggaguucuuugaugagacccguagauugugcgaccucaggcuguuccagcccuuucugaaaguaauugagccuguggguaaucgggaagagaagauccucaaccgcgaaauaggcuucgccaucgggaugccagucugugaguuugauauggugaaagaccccgaaguucaggauuucagaaggaauauuuuaaacgugugcaaggaggcggucgaccugcgggaucuuaauagcccucauucccgcgcuauguacguguauccaccgaacguagagucuucgcccgaauugccuaagcacaucuacaauaaacuggacaagggacaaauuaucguugugauaugggucauugugucaccaaacaaugauaaacagaaguauacacuaaaaaucaaccaugacugugugcccgagcaggucauugccgaagcaauccgaaagaagacuagaagcaugcuccugaguuccgagcagcuuaaacugugcguuuuggaauaccaaggcaaguauauccucaaagugugugguugcgaugaguacuuucuggagaaguacccuuuaucucaguauaaauacauuaggagcuguauaaugcuggggcggaugccaaaucucaugcuuauggccaaggaaucccuguauucacaguugcccauggacugcuucaccaugccgaguuacagccgucgcaucucuacagcuaccccuuauaugaacggagagacuuccacaaaaucacuauggguaauuaauagcgcacugagaaucaagauacucugugccaccuacgugaacgucaauauuagggauaucgacaagaucuaugugcggacgggcauuuaccacggcggggaaccccugugcgacaacguuaacacucagcgagugccaugcaguaauccucgcuggaacgaguggcuuaauuacgauaucuauauucccgaccugccaagagcugccagguugugucucucuauaugcuccgucaaaggacggaagggugcgaaagaagaacacuguccccuggcauggggcaacaucaauuuauuugauuacaccgacacacuggugagcgggaagauggcccuaaaccucuggccuguaccacauggacuggaggaucuuuugaauccgauuggcguuacugguucgaaccccaauaaagaaaccccuugccuggagcucgaguucgacugguuuucuuccguggucaaguucccagauaugucagugaucgaggagcacgcuaacuggagugucagccgcgaagccggguucuccuauucucaugcaggacugagcaauagacuugcuagggacaacgagcugcgugaaaaugauaaggagcaauugaaagccaucucaacacgggacccccucagugaaauuaccgagcaggagaaggauuuucuguggucccaccgacacuacugugugacgauaccugaaaucuuaccaaaacugcuacucagcguuaaguggaacucuagagacgagguggcgcagauguauugccugguaaaagacuggcccccgauuaagccugaacaagccauggagcuuuuggauuguaauuacccagaccccauggucaggggcuucgcagugcgcugccuggaaaaguaucucacugaugacaaacugucacaguacuuaauccagcugguucaggugcuuaaguacgagcaauauuuggauaaccuccugguccgguuucuacugaaaaaggcucucacaaaccagagaauuggccauuucuuuuucuggcaccugaaaagugagaugcauaauaagaccgugagccagagguuugggcuuuugcuggaauccuacugucgcgccugcggaauguauuuaaagcaccucaaccgacagguagaggcuauggaaaaacugaucaaucuuacugacauacugaagcaagagaaaaaggaugaaacacagaaagugcagaugaaguucuugguugagcagaugcggcguccugacuuuauggaugcccuccaagguuuccugucuccccuaaacccagcacaucagcugggcaaucucagacuggaggaauguaggaucaugucgagcgccaaacgcccucuuugguugaacugggagaaucccgacauuauguccgaacuguuauuucagaacaaugagaucauuuucaagaacggggaugaccuccggcaggauaugcugacccuucaaaucauaagaauuauggagaauaucuggcagaaccagggacuggaccuaaggaugcucccauacggcugccugucaauuggugacugcgucggguugaucgaaguggugcgaaauagucacacgauaaugcaaauccaguguaagggcggacugaaaggcgcuuuacaguuuaacucucacacccuccaucaguggcugaaggauaaaaauaagggggagauuuaugacgcggcaaucgaucuuuucacacgcagcugcgccggauacugugucgcuacuuucauucuggguaucggcgaccggcacaacuccaacauaaugguuaaagaugacgggcaauuguuucauauugauuucggacacuuucucgaccacaagaagaaaaaguucggcuauaaaagagaaagggugccguuugugcugacccaggauuuccuaaucguaaucucaaagggugcccaggagugcacaaaaacucgugaauuugagcgcuuccaggagauguguuacaaggcauaccuggccauucggcaacaugcuaaucuuuuuaucaaccucuucagcaugaugcuggggucuggcaugccugaauugcaguccuuugacgauauugccuauauaagaaagacccuggcauuagacaaaacagagcaggaagcgcucgaguacuucaugaagcagaugaaugaugcucaccauggaggcuggaccacuaaaauggacuggaucuuucacacgauuaagcaacaugcccugaacuga

SEQ ID NO: 9212 - RNA, 3207 nt, Artificial Sequence
  derived and/or modified sequence opt4 from PI3K__Homo_sapiens__AAB39753
augccccccagacccagcagcggcgagcuguggggcauccaccugaugccccccagaauccugguggagugccugcugcccaacggcaugaucgugacccuggagugccugagagaggccacccugaucaccaucaagcacgagcuguucaaggaggccagaaaguacccccugcaccagcugcugcaggacgagagcagcuacaucuucgugagcgugacccaggaggccgagagagaggaguucuucgacgagaccagaagacugugcgaccugagacuguuccagcccuuccugaaggugaucgagcccgugggcaacagagaggagaagauccugaacagagagaucggcuucgccaucggcaugcccgugugcgaguucgacauggugaaggaccccgaggugcaggacuucagaagaaacauccugaacgugugcaaggaggccguggaccugagagaccugaacagcccccacagcagagccauguacguguacccccccaacguggagagcagccccgagcugcccaagcacaucuacaacaagcuggacaagggccagaucaucguggugaucugggugaucgugagccccaacaacgacaagcagaaguacacccugaagaucaaccacgacugcgugcccgagcaggugaucgccgaggccaucagaaagaagaccagaagcaugcugcugagcagcgagcagcugaagcugugcgugcuggaguaccagggcaaguacauccugaaggugugcggcugcgacgaguacuuccuggagaaguacccccugagccaguacaaguacaucagaagcugcaucaugcugggcagaaugcccaaccugaugcugauggccaaggagagccuguacagccagcugcccauggacugcuucaccaugcccagcuacagcagaagaaucagcaccgccacccccuacaugaacggcgagaccagcaccaagagccugugggugaucaacagcgcccugagaaucaagauccugugcgccaccuacgugaacgugaacaucagagacaucgacaagaucuacgugagaaccggcaucuaccacggcggcgagccccugugcgacaacgugaacacccagagagugcccugcagcaaccccagauggaacgaguggcugaacuacgacaucuacauccccgaccugcccagagccgccagacugugccugagcaucugcagcgugaagggcagaaagggcgccaaggaggagcacugcccccuggccuggggcaacaucaaccuguucgacuacaccgacacccuggugagcggcaagauggcccugaaccuguggcccgugccccacggccuggaggaccugcugaaccccaucggcgugaccggcagcaaccccaacaaggagacccccugccuggagcuggaguucgacugguucagcagcguggugaaguuccccgacaugagcgugaucgaggagcacgccaacuggagcgugagcagagaggccggcuucagcuacagccacgccggccugagcaacagacuggccagagacaacgagcugagagagaacgacaaggagcagcugaaggccaucagcaccagagacccccugagcgagaucaccgagcaggagaaggacuuccuguggagccacagacacuacugcgugaccauccccgagauccugcccaagcugcugcugagcgugaaguggaacagcagagacgagguggcccagauguacugccuggugaaggacuggccccccaucaagcccgagcaggccauggagcugcuggacugcaacuaccccgaccccauggugagaggcuucgccgugagaugccuggagaaguaccugaccgacgacaagcugagccaguaccugauccagcuggugcaggugcugaaguacgagcaguaccuggacaaccugcuggugagauuccugcugaagaaggcccugaccaaccagagaaucggccacuucuucuucuggcaccugaagagcgagaugcacaacaagaccgugagccagagauucggccugcugcuggagagcuacugcagagccugcggcauguaccugaagcaccugaacagacagguggaggccauggagaagcugaucaaccugaccgacauccugaagcaggagaagaaggacgagacccagaaggugcagaugaaguuccugguggagcagaugagaagacccgacuucauggacgcccugcagggcuuccugagcccccugaaccccgcccaccagcugggcaaccugagacuggaggagugcagaaucaugagcagcgccaagagaccccuguggcugaacugggagaaccccgacaucaugagcgagcugcuguuccagaacaacgagaucaucuucaagaacggcgacgaccugagacaggacaugcugacccugcagaucaucagaaucauggagaacaucuggcagaaccagggccuggaccugagaaugcugcccuacggcugccugagcaucggcgacugcgugggccugaucgagguggugagaaacagccacaccaucaugcagauccagugcaagggcggccugaagggcgcccugcaguucaacagccacacccugcaccaguggcugaaggacaagaacaagggcgagaucuacgacgccgccaucgaccuguucaccagaagcugcgccggcuacugcguggccaccuucauccugggcaucggcgacagacacaacagcaacaucauggugaaggacgacggccagcuguuccacaucgacuucggccacuuccuggaccacaagaagaagaaguucggcuacaagagagagagagugcccuucgugcugacccaggacuuccugaucgugaucagcaagggcgcccaggagugcaccaagaccagagaguucgagagauuccaggagaugugcuacaaggccuaccuggccaucagacagcacgccaaccuguucaucaaccuguucagcaugaugcugggcagcggcaugcccgagcugcagagcuucgacgacaucgccuacaucagaaagacccuggcccuggacaagaccgagcaggaggcccuggaguacuucaugaagcagaugaacgacgcccaccacggcggcuggaccaccaagauggacuggaucuuccacaccaucaagcagcacgcccugaacuga

SEQ ID NO: 9213 - RNA, 3207 nt, Artificial Sequence
  derived and/or modified sequence opt5 from PI3K__Homo_sapiens__AAB39753
augcccccuagaccgagcuccggcgagcugugggggauccaccucaugcccccucggauucugguggaaugccuucugcccaacggaaugaucgucacccucgagugucugcgcgaagccacacuuauuacgaucaagcaugagcuguucaaagaagcuagaaaguacccucuccaccagcugcugcaagacgagucuagcuauauuuuuguuuccgugacccaggaggccgaacgggaggaguucuuugaugagacacgcagacucugcgaccugcggcuuuuccagcccuuucugaaagugaucgagccugucggcaaucgcgaagagaagauccucaacagagaaauuggguucgcgaucggaaugccggugugugaguuugauaugguuaaagaccccgaagugcaggauuuccggcgcaauauucugaacgucugcaaggaggcuguggaccuuagagaucucaauucuccucauagccgggccauguacguuuaucccccuaacguggaguccucucccgaacugccgaagcacaucuacaauaaacuggacaagggccaaauuaucgucgugauuugggugaucgucagcccuaacaaugauaaacagaaguauacccugaaaaucaaccaugacuguguucccgaacaggugauugccgaagcuauccgcaagaagacaagauccaugcuccugagcucugagcagcuuaaacugugcgugcucgaauaccaagggaaguauauucugaaagucuguggaugcgaugaguacuuucuugagaaguacccucugucccaguauaaauacauccggagcuguauuaugcucggccgcaugcccaaucugaugcugauggccaaggaaucucucuauucccagcugcccauggacugcuucaccaugccuagcuacucuagacggaucuccacagcuaccccguauaugaacggcgagacgagcaccaaaucccuuugggugaucaauucugcccugagaauuaagauccucugugcgacauacguuaacgugaauauucgcgauaucgacaagauuuauguccggaccgggaucuaccacggaggcgaaccccugugcgacaacgugaacacacagagaguuccuugcagcaauccccgcuggaacgaguggcuuaauuacgauaucuauauuccugaccugccccgggccgcuagacucugucuguccaucugcagcgugaaagggcgcaagggagccaaagaagaacacuguccgcuggcuuggggcaacauuaaucucuuugauuacaccgacacgcuggucucugggaagauggcccuuaaccuguggccugugccccauggacucgaggaucugcugaauccuaucggcgucacaggcuccaaccccaauaaagaaaccccuugccuugagcucgaguucgacugguuuagcucugugguuaaguuccccgauaugagcgugauugaggagcacgcgaacugguccgucucucgggaagccggguucagcuauucccaugcuggacugagcaauagacuggcccgcgacaacgagcuccgggaaaaugauaaggagcaacugaaagcuaucucuacaagagacccgcuuuccgaaauuaccgagcaggagaaggauuuucuguggagccaccgccacuacugugugaccaucccugaaauccuccccaaacugcugcuuucuguuaaguggaacucccgggacgagguggcccagauguauugccucgucaaagacuggcccccuauuaagccggaacaagccauggagcugcuggauuguaauuaccccgacccuauggugagaggcuucgcugugcggugccucgaaaaguaucugacagaugacaaacuuagccaguaccugauccagcucguucagguccugaaguacgagcaauaucuggauaaccuucucgugcgcuuucugcugaaaaaggcgcucacgaaccagagaauugggcauuucuuuuucuggcaccugaaauccgagaugcauaauaagaccgugucucagcgguuuggacuucugcucgaaagcuacuguagagccugcggcauguaucugaagcaccugaaccgccaggucgaggcuauggaaaaacuuaucaaucucacagacauucugaagcaagagaaaaaggaugaaacccagaaagugcagaugaaguuccugguugagcagaugcggagacccgacuuuauggaugcccuccaaggguuccuguccccucuuaaccccgcccaucagcugggaaaucuccgccuggaggaauguagaaucaugucuagcgcuaaacggccucuguggcuuaacugggagaaucccgacaucauguccgaacugcucuuucagaacaaugagauuaucuucaagaacggcgaugaccugcgccaggauaugcucacacugcaaauuaucagaauuauggagaauaucuggcagaaccagggccuugaccugcggaugcucccguacgggugccugagcaucggagacugcgugggccugauugaagucgugcgcaauucucacaccaucaugcaaauucaguguaaagggggacuuaagggcgcccugcaguuuaacucccacacgcuccaucaguggcugaaggauaaaaauaagggggagaucuaugacgcggcuauugaucucuucacaagaagcugcgccggcuacuguguugccaccuucauccugggaaucggcgaccggcacaacucuaacauuauggugaaagaugacgggcaacuuuuucauaucgauuucggacacuuucuggaccacaagaagaaaaaguucggcuauaaacgcgaaagagucccuuuugugcucacccaggauuuccugauuguuaucuccaagggggcucaggagugcacaaaaacccgggaauuugagcgcuuccaggagauguguuacaaggccuaccuggcuauuagacaacaugccaaucuuuuuaucaaccuguucagcaugaugcucggaucuggcaugcccgaacugcagagcuuugacgauauugcguauauccggaagacacucgcccuggacaaaacggagcaggaagcucuugaguacuucaugaagcagaugaaugaugcccaccaugggggcuggaccacaaaaauggacuggaucuuucacaccauuaagcaacaugcucugaacuga

SEQ ID NO: 9214 - protein, 1070 aa, Artificial Sequence
  PI3K__Homo_sapiens__P42338
MCFSFIMPPAMADILDIWAVDSQIASDGSIPVDFLLPTGIYIQLEVPREATISYIKQMLWKQVHNYPMFNLLMDIDSYMFACVNQTAVYEELEDETRRLCDVRPFLPVLKLVTRSCDPGEKLDSKIGVLIGKGLHEFDSLKDPEVNEFRRKMRKFSEEKILSLVGLSWMDWLKQTYPPEHEPSIPENLEDKLYGGKLIVAVHFENCQDVFSFQVSPNMNPIKVNELAIQKRLTIHGKEDEVSPYDYVLQVSGRVEYVFGDHPLIQFQYIRNCVMNRALPHFILVECCKIKKMYEQEMIAIEAAINRNSSNLPLPLPPKKTRIISHVWENNNPFQIVLVKGNKLNTEETVKVHVRAGLFHGTELLCKTIVSSEVSGKNDHIWNEPLEFDINICDLPRMARLCFAVYAVLDKVKTKKSTKTINPSKYQTIRKAGKVHYPVAWVNTMVFDFKGQLRTGDIILHSWSSFPDELEEMLNPMGTVQTNPYTENATALHVKFPENKKQPYYYPPFDKIIEKAAEIASSDSANVSSRGGKKFLPVLKEILDRDPLSQLCENEMDLIWTLRQDCREIFPQSLPKLLLSIKWNKLEDVAQLQALLQIWPKLPPREALELLDFNYPDQYVREYAVGCLRQMSDEELSQYLLQLVQVLKYEPFLDCALSRFLLERALGNRRIGQFLFWHLRSEVHIPAVSVQFGVILEAYCRGSVGHMKVLSKQVEALNKLKTLNSLIKLNAVKLNRAKGKEAMHTCLKQSAYREALSDLQSPLNPCVILSELYVEKCKYMDSKMKPLWLVYNNKVFGEDSVGVIFKNGDDLRQDMLTLQMLRLMDLLWKEAGLDLRMLPYGCLATGDRSGLIEVVSTSETIADIQLNSSNVAAAAAFNKDALLNWLKEYNSGDDLDRAIEEFTLSCAGYCVASYVLGIGDRHSDNIMVKKTGQLFHIDFGHILGNFKSKFGIKRERVPFILTYDFIHVIQQGKTGNTEKFGRFRQCCEDAYLILRRHGNLFITLFALMLTAGLPELTSVKDIQYLKDSLALGKSEEEALKQFKQKFDEALRESWTTKVNWMAHTVRKDYRS

SEQ ID NO: 9215 - RNA, 3213 nt, Artificial Sequence
  PI3K__Homo_sapiens__AAB29081
augugcuucaguuucauaaugccuccugcuauggcagacauccuugacaucugggcgguggauucacagauagcaucugauggcuccauaccuguggauuuccuuuugcccacugggauuuauauccaguuggagguaccucgggaagcuaccauuucuuauauuaagcagauguuauggaagcaaguucacaauuacccaauguucaaccuccuuauggauauugacuccuauauguuugcaugugugaaucagacugcuguauaugaggagcuugaagaugaaacacgaagacucugugaugucagaccuuuucuuccaguucucaaauuagugacaagaaguugugacccaggggaaaaauuagacucaaaaauuggaguccuuauaggaaaaggucugcaugaauuugauuccuugaaggauccugaaguaaaugaauuucgaagaaaaaugcgcaaauucagcgaggaaaaaauccugucacuugugggauugucuuggauggacuggcuaaaacaaacauauccaccagagcaugaaccauccaucccugaaaacuuagaagauaaacuuuaugggggaaagcucaucguagcuguucauuuugaaaacugccaggacguguuuagcuuucaagugucuccuaauaugaauccuaucaaaguaaaugaauuggcaauccaaaaacguuugacuauucaugggaaggaagaugaaguuagccccuaugauuauguguugcaagucagcgggagaguagaauauguuuuuggugaucauccacuaauucaguuccaguauauccggaacugugugaugaacagagcccugccccauuuuauacuuguggaaugcugcaagaucaagaaaauguaugaacaagaaaugauugccauagaggcugccauaaaucgaaauucaucuaaucuuccucuuccauuaccaccaaagaaaacacgaauuauuucucauguuugggaaaauaacaacccuuuccaaauugucuugguuaagggaaauaaacuuaacacagaggaaacuguaaaaguucaugucagggcuggucuuuuucaugguacugagcuccuguguaaaaccaucguaagcucagagguaucagggaaaaaugaucauauuuggaaugaaccacuggaauuugauauuaauauuugugacuuaccaagaauggcucgauuauguuuugcuguuuaugcaguuuuggauaaaguaaaaacgaagaaaucaacgaaaacuauuaaucccucuaaauaucagaccaucaggaaagcuggaaaagugcauuauccuguagcguggguaaauacgaugguuuuugacuuuaaaggacaauugagaacuggagacauaauauuacacagcuggucuucauuuccugaugaacucgaagaaauguugaauccaaugggaacuguucaaacaaauccauauacugaaaaugcaacagcuuugcauguuaaauuuccagagaauaaaaaacaaccuuauuauuacccucccuucgauaagauuauugaaaaggcagcugagauugcaagcagugauagugcuaaugugucaagucgagguggaaaaaaguuucuuccuguauugaaagaaaucuuggacagggaucccuugucucaacugugugaaaaugaaauggaucuuauuuggacuuugcgacaagacugccgagagauuuucccacaaucacugccaaaauuacugcugucaaucaaguggaauaaacuugaggauguugcucagcuucaggcgcugcuucagauuuggccuaaacugcccccccgggaggcccuagagcuucuggauuucaacuauccagaccaguacguucgagaauaugcuguaggcugccugcgacagaugagugaugaagaacuuucucaauaucuuuuacaacuggugcaaguguuaaaauaugagccuuuucuugauugugcccucucuagauuccuauuagaaagagcacuugguaaucggaggauagggcaguuucuauuuuggcaucuuaggucagaagugcacauuccugcugucucaguacaauuuggugucauccuugaagcauacugccggggaaguguggggcacaugaaagugcuuucuaagcagguugaagcacucaauaaguuaaaaacuuuaaauaguuuaaucaaacugaaugccgugaaguuaaacagagccaaagggaaggaggccaugcauaccuguuuaaaacagagugcuuaccgggaagcccucucugaccugcagucaccccugaacccauguguuauccucucagaacucuauguugaaaagugcaaauacauggauuccaaaaugaagccuuuguggcugguauacaauaacaagguauuuggugaggauucaguuggagugauuuuuaaaaauggugaugauuuacgacaggauauguugacacuccaaauguugcgcuugauggauuuacucuggaaagaagcugguuuggaucuucggauguugccuuauggcuguuuagcaacaggagaucgcucuggccucauugaaguugugagcaccucugaaacaauugcugacauucagcugaacaguagcaauguggcugcugcagcagccuucaacaaagaugcccuucugaacuggcuuaaagaauacaacucuggggaugaccuggaccgagccauugaggaauuuacacuguccugugcuggcuacuguguagcuucuuauguccuugggauuggugacagacauagugacaacaucauggucaaaaaaacuggccagcucuuccacauugacuuuggacauauucuuggaaauuucaaaucuaaguuuggcauuaaaagggagcgagugccuuuuauucuuaccuaugauuucauccaugucauucaacaaggaaaaacaggaaauacagaaaaguuuggccgguuccgccaguguugugaggaugcauaucugauuuuacgacggcaugggaaucucuucaucacucucuuugcgcugauguugacugcagggcuuccugaacucacaucagucaaagauauacaguaucuuaaggacucucuugcauuagggaagagugaagaagaagcacucaaacaguuuaagcaaaaauuugaugaggcgcucagggaaagcuggacuacuaaagugaacuggauggcccacacaguucggaaagacuacagaucuuaa

SEQ ID NO: 9216 - RNA, 3213 nt, Artificial Sequence
  derived and/or modified sequence opt1 from PI3K__Homo_sapiens__AAB29081
augugcuucagcuucaucaugcccccggccauggccgacauccuggacaucugggcgguggacucccagaucgccagcgacggcuccauccccgucgacuuccuccugcccaccgggaucuacauccagcuggaggugccccgcgaggccaccaucagcuacaucaagcagaugcucuggaagcagguccacaacuacccgauguucaaccugcugauggacaucgacuccuacauguucgccugcgugaaccagacggccguguacgaggagcucgaggacgagacccggcgccugugcgacgugcggcccuuccugcccguccucaagcuggugacccgcagcugcgaccccggcgagaagcuggacuccaagaucggggugcucaucggcaaggggcugcacgaguucgacagccugaaggacccggaggucaacgaguuccggcgcaagaugcggaaguucuccgaggagaagauccucagccuggugggccuguccuggauggacuggcucaagcagaccuacccgcccgagcacgagcccagcauccccgagaaccuggaggacaagcuguacggcgggaagcucaucguggcgguccacuucgagaacugccaggacguguucuccuuccaggugagccccaacaugaaccccaucaaggucaacgagcuggccauccagaagcgccugacgauccacggcaaggaggacgaggugucccccuacgacuacgugcuccaggucagcgggcggguggaguacguguucggcgaccacccgcugauccaguuccaguacauccgcaacugcgucaugaaccgggcccugccccacuucauccucguggagugcugcaagaucaagaagauguacgagcaggagaugaucgccaucgaggcggccaucaaccgcaacuccagcaaccugccccugccccucccgcccaagaagacccggaucaucucccacgugugggagaacaacaaccccuuccagaucguccuggugaaggggaacaagcugaacaccgaggagaccgucaaggugcacgugcgcgccggccucuuccacggcacggagcugcugugcaagaccaucgucagcagcgagguguccgggaagaacgaccacaucuggaacgagccccucgaguucgacaucaacaucugcgaccugccgcggauggcccgccugugcuucgccguguacgcgguccucgacaaggugaagaccaagaaguccaccaagacgaucaaccccagcaaguaccagaccauccggaaggccggcaaggugcacuaccccgucgccugggugaacaccaugguguucgacuucaaggggcagcugcgcaccggcgacaucauccugcacagcugguccagcuuccccgacgagcucgaggagaugcugaacccgaugggcacgguccagaccaaccccuacaccgagaacgccaccgcccugcacgugaaguuccccgagaacaagaagcagccguacuacuacccgcccuucgacaagaucaucgagaaggcggccgagaucgccuccagcgacuccgccaacgugagcucccgcgggggcaagaaguuccuccccguccugaaggagauccuggaccgggacccccucagccagcugugcgagaacgagauggaccugaucuggacgcugcggcaggacugccgcgagaucuucccccagucccuccccaagcugcugcucagcaucaaguggaacaagcuggaggacguggcccagcugcaggcgcuccugcagaucuggcccaagcugccgccccgcgaggcccucgagcugcuggacuucaacuaccccgaccaguacgugcgggaguacgccgucgggugccuccgccagauguccgacgaggagcugagccaguaccugcuccagcugguccaggugcugaaguacgagcccuuccucgacugcgcccugucccgguuccugcucgagcgcgcccugggcaaccggcgcaucgggcaguuccuguucuggcaccuccggagcgaggugcacaucccggcgguguccgugcaguucggcgucauccuggaggccuacugccgcggcagcguggggcacaugaaggugcugagcaagcaggucgaggcccucaacaagcugaagacccugaacucccucaucaagcugaacgccgugaagcugaaccgggcgaagggcaaggaggccaugcacacgugccucaagcagagcgccuaccgcgaggcccuguccgaccugcagagcccccucaaccccugcgugauccuguccgagcuguacgucgagaagugcaaguacauggacagcaagaugaagccccucuggcugguguacaacaacaagguguucggggaggacuccgucggcgugaucuucaagaacggggacgaccugcggcaggacaugcucacccugcagaugcugcgccucauggaccugcuguggaaggaggccggccucgaccugcggaugcugccguacggcugccucgcgacgggggaccgcagcggccugaucgagguggucuccaccagcgagaccaucgccgacauccagcugaacuccagcaacguggccgccgccgcggccuucaacaaggacgcccuccugaacuggcugaaggaguacaacuccggggacgaccucgaccgggccaucgaggaguucacccugagcugcgccggcuacugcguggcguccuacguccuggggaucggcgaccgccacagcgacaacaucauggugaagaagacgggccagcuguuccacaucgacuucgggcacauccucggcaacuucaaguccaaguucgggaucaagcgggagcgcgugcccuucauccugaccuacgacuucauccacgucauccagcagggcaagaccggcaacaccgagaaguucgggcgguuccgccagugcugcgaggacgccuaccucauccugcgccggcacggcaaccuguucaucacccucuucgcccugaugcugaccgccgggcuccccgagcugaccagcgugaaggacauccaguaccugaaggacagccucgcgcugggcaaguccgaggaggaggcccugaagcaguucaagcagaaguucgacgaggcccuccgcgagagcuggaccacgaaggugaacuggauggcccacaccguccggaaggacuaccgcuccuga

SEQ ID NO: 9217 - RNA, 3213 nt, Artificial Sequence
  derived and/or modified sequence opt2 from PI3K__Homo_sapiens__AAB29081
augugcuucuccuucaucaugccccccgccauggccgacauccucgacaucugggccgucgacucccagaucgccuccgacggcuccauccccgucgacuuccuccuccccaccggcaucuacauccagcucgaggucccccgcgaggccaccaucuccuacaucaagcagaugcucuggaagcagguccacaacuaccccauguucaaccuccucauggacaucgacuccuacauguucgccugcgucaaccagaccgccgucuacgaggagcucgaggacgagacccgccgccucugcgacguccgccccuuccuccccguccucaagcucgucacccgcuccugcgaccccggcgagaagcucgacuccaagaucggcguccucaucggcaagggccuccacgaguucgacucccucaaggaccccgaggucaacgaguuccgccgcaagaugcgcaaguucuccgaggagaagauccucucccucgucggccucuccuggauggacuggcucaagcagaccuacccccccgagcacgagcccuccauccccgagaaccucgaggacaagcucuacggcggcaagcucaucgucgccguccacuucgagaacugccaggacgucuucuccuuccaggucucccccaacaugaaccccaucaaggucaacgagcucgccauccagaagcgccucaccauccacggcaaggaggacgaggucucccccuacgacuacguccuccaggucuccggccgcgucgaguacgucuucggcgaccacccccucauccaguuccaguacauccgcaacugcgucaugaaccgcgcccucccccacuucauccucgucgagugcugcaagaucaagaagauguacgagcaggagaugaucgccaucgaggccgccaucaaccgcaacuccuccaaccucccccucccccucccccccaagaagacccgcaucaucucccacgucugggagaacaacaaccccuuccagaucguccucgucaagggcaacaagcucaacaccgaggagaccgucaagguccacguccgcgccggccucuuccacggcaccgagcuccucugcaagaccaucgucuccuccgaggucuccggcaagaacgaccacaucuggaacgagccccucgaguucgacaucaacaucugcgaccucccccgcauggcccgccucugcuucgccgucuacgccguccucgacaaggucaagaccaagaaguccaccaagaccaucaaccccuccaaguaccagaccauccgcaaggccggcaagguccacuaccccgucgccugggucaacaccauggucuucgacuucaagggccagcuccgcaccggcgacaucauccuccacuccugguccuccuuccccgacgagcucgaggagaugcucaaccccaugggcaccguccagaccaaccccuacaccgagaacgccaccgcccuccacgucaaguuccccgagaacaagaagcagcccuacuacuacccccccuucgacaagaucaucgagaaggccgccgagaucgccuccuccgacuccgccaacgucuccucccgcggcggcaagaaguuccuccccguccucaaggagauccucgaccgcgacccccucucccagcucugcgagaacgagauggaccucaucuggacccuccgccaggacugccgcgagaucuucccccagucccuccccaagcuccuccucuccaucaaguggaacaagcucgaggacgucgcccagcuccaggcccuccuccagaucuggcccaagcuccccccccgcgaggcccucgagcuccucgacuucaacuaccccgaccaguacguccgcgaguacgccgucggcugccuccgccagauguccgacgaggagcucucccaguaccuccuccagcucguccagguccucaaguacgagcccuuccucgacugcgcccucucccgcuuccuccucgagcgcgcccucggcaaccgccgcaucggccaguuccucuucuggcaccuccgcuccgagguccacauccccgccgucuccguccaguucggcgucauccucgaggccuacugccgcggcuccgucggccacaugaagguccucuccaagcaggucgaggcccucaacaagcucaagacccucaacucccucaucaagcucaacgccgucaagcucaaccgcgccaagggcaaggaggccaugcacaccugccucaagcaguccgccuaccgcgaggcccucuccgaccuccaguccccccucaaccccugcgucauccucuccgagcucuacgucgagaagugcaaguacauggacuccaagaugaagccccucuggcucgucuacaacaacaaggucuucggcgaggacuccgucggcgucaucuucaagaacggcgacgaccuccgccaggacaugcucacccuccagaugcuccgccucauggaccuccucuggaaggaggccggccucgaccuccgcaugcuccccuacggcugccucgccaccggcgaccgcuccggccucaucgaggucgucuccaccuccgagaccaucgccgacauccagcucaacuccuccaacgucgccgccgccgccgccuucaacaaggacgcccuccucaacuggcucaaggaguacaacuccggcgacgaccucgaccgcgccaucgaggaguucacccucuccugcgccggcuacugcgucgccuccuacguccucggcaucggcgaccgccacuccgacaacaucauggucaagaagaccggccagcucuuccacaucgacuucggccacauccucggcaacuucaaguccaaguucggcaucaagcgcgagcgcguccccuucauccucaccuacgacuucauccacgucauccagcagggcaagaccggcaacaccgagaaguucggccgcuuccgccagugcugcgaggacgccuaccucauccuccgccgccacggcaaccucuucaucacccucuucgcccucaugcucaccgccggccuccccgagcucaccuccgucaaggacauccaguaccucaaggacucccucgcccucggcaaguccgaggaggaggcccucaagcaguucaagcagaaguucgacgaggcccuccgcgaguccuggaccaccaaggucaacuggauggcccacaccguccgcaaggacuaccgcuccuga

SEQ ID NO: 9218 - RNA, 3213 nt, Artificial Sequence
  derived and/or modified sequence opt3 from PI3K__Homo_sapiens__AAB29081
augugcuucagcuuuaucaugcccccugccauggcugacauucuggauauaugggcaguggacucccagaucgccucugauggcucaauuccagucgacuuccuccuuccgaccgggaucuacauucaacuggagguucccagagaagcgacaaucaguuauauaaagcagauguuguggaaacaggugcacaacuacccuauguuuaauuuacugauggauaucgacagcuauauguucgcuuguguaaaccagacugccguguacgaggaacuagaggaugaaacgaggcggcucugcgacguccgcccauuucugcccgugcuuaagcugguuacccgauccugugauccuggagagaaauuggacucuaagauuggugugcucaucggcaaagggcugcaugaguucgauucgcugaaggacccagaagucaaugaguuucguagaaagaugaggaaauucucagaagagaagauucucagcuuagugggacugaguuggauggauuggcuuaaacaaacauaucccccugagcacgaaccauccaucccggagaacuuggaagacaagcuguacggcgguaaacuaauaguagcaguucauuuugagaauugccaggacguguucucuuuucaggucagccccaacaugaauccuauuaaggugaacgaacucgccauccagaagcggcugacuauucacgggaaagaggaugagguguccccauaugacuacguccuucaaguuucaggacgcguggaauacguauucggcgaucauccccugauccaguuucaguauaucagaaauugugugaugaacagggcuuugccucacuucauucucgucgagugcuguaagaucaaaaagauguacgaacaggagaugauagcaauugaagccgcuaucaaucggaacaguagcaaucugccauuaccccugccgccuaaaaagacccgcauaauuucucacgugugggagaacaauaaccccuuccaaaucguucucgugaaaggcaacaaguugaauacagaggaaaccgucaaggugcauguacgagccgggcuguuucacggaacugaguugcuaugcaaaacaaucguuuccucagaagugagcgguaagaacgaccauauuuggaaugagccacuggaguucgauaucaacauuugugaccucccuagaauggcgaggcugugcuuugcagucuaugccgugcuugauaaagucaagaccaaaaagaguacgaagacuauaaaucccucuaaauaccagaccauccggaaggcuggcaaagugcacuauccaguugccugggugaacacaaugguauucgacuuuaaggggcagcugcguacuggagauauuaucuugcacuccuggagcucguuccccgacgaacucgaggaaaugcugaauccuaugggcaccguccaaacaaacccauacaccgagaaugcaacggcuuuacaugugaaauuuccggaaaacaagaagcagcccuauuacuacccuccauucgauaaaaucauugagaaggccgcggagauagccucuuccgacucagcaaauguuaguagccgcggugggaaaaaguuucugcccgugcuaaaagaaauccucgacagagauccucugucccagcuuugugagaacgaaauggacuugauuuggacucugaggcaggauugccgggagaucuucccacaaucucuccccaagcugcuucugagcauuaaguggaauaaauuggaagacgucgcucagcuccaggcccuguuacagaucuggccgaagcugccuccacgagaggcucuagagcuccuggauuuuaacuaucccgaccaauacgugcgcgaauaugccguaggaugccuuagacagaugucagaugaggaauugagucaguaccugcuccagcuggugcaaguuuuaaaauaugagccuuuccuggacugugcacuuuccagguuuuugcucgaacgggcccugggcaaucgcagaauaggccaguuccuauucuggcaccugaggagcgagguccauauccccgcugugucugugcaguuuggggucauucucgaggcguacugccguggaucaguuggucacaugaaggugcugaguaaacagguggaagcacuuaacaaguugaaaacacugaacagcuuaaucaagcucaaugccguaaagcugaaccgggcuaaaggcaaggaggccaugcauaccugucuuaaacaauccgcauaucgagaagcccugucugauuugcagucgccacucaauccuugcgucauucugagcgagcuauacguggaaaaguguaaauacauggacuccaagaugaagccccuguggcucguuuauaacaauaaaguguucggggaggauucagucggagugaucuuuaagaacggcgacgaucugagacaggacaugcuuacuuugcaaaugcugagguuaauggaccuccuguggaaagaggcuggucuugaucugcgcaugcuaccauacgggugccucgccacaggcgaccggaguggacugauagaaguugugucuaccagcgagacgauugcagauauccagcuuaauuccucaaacguagcggcugccgcagccuucaauaaggacgcucuguuaaacuggcucaaagaauauaauagcggcgaugaccuggauagagccauugaggaguuuacccuuucuugugcaggguacugcgucgcuuccuaugugcugggaaucggugacaggcacagugauaacauaauggugaagaagacaggccaguuguuccacaucgacuuugggcauauucucggaaauuucaaaagcaaguuuggcaucaaacgcgaacgagucccguucauucugacuuacgauuuuauccacguuauacagcaagguaagaccgggaacacagagaaauucggccgguuucgucaguguugcgaagacgccuaucuaauucugagaaggcauggaaaucuuuucaucacucucuucgcgcugauguugaccgccggccugccugaguuaacaucugugaaggauauccaguaccucaaggacucccuggcucuugggaaaucagaagaggaggcacugaagcaguuuaaacaaaaguucgacgaagccuugcgcgagaguuggaccacuaaaguaaacuggauggcucacacggugcggaaggauuacagaagcuga

SEQ ID NO: 9219 - RNA, 3213 nt, Artificial Sequence
  derived and/or modified sequence opt4 from PI3K__Homo_sapiens__AAB29081
augugcuucagcuucaucaugccccccgccauggccgacauccuggacaucugggccguggacagccagaucgccagcgacggcagcauccccguggacuuccugcugcccaccggcaucuacauccagcuggaggugcccagagaggccaccaucagcuacaucaagcagaugcuguggaagcaggugcacaacuaccccauguucaaccugcugauggacaucgacagcuacauguucgccugcgugaaccagaccgccguguacgaggagcuggaggacgagaccagaagacugugcgacgugagacccuuccugcccgugcugaagcuggugaccagaagcugcgaccccggcgagaagcuggacagcaagaucggcgugcugaucggcaagggccugcacgaguucgacagccugaaggaccccgaggugaacgaguucagaagaaagaugagaaaguucagcgaggagaagauccugagccuggugggccugagcuggauggacuggcugaagcagaccuacccccccgagcacgagcccagcauccccgagaaccuggaggacaagcuguacggcggcaagcugaucguggccgugcacuucgagaacugccaggacguguucagcuuccaggugagccccaacaugaaccccaucaaggugaacgagcuggccauccagaagagacugaccauccacggcaaggaggacgaggugagccccuacgacuacgugcugcaggugagcggcagaguggaguacguguucggcgaccacccccugauccaguuccaguacaucagaaacugcgugaugaacagagcccugccccacuucauccugguggagugcugcaagaucaagaagauguacgagcaggagaugaucgccaucgaggccgccaucaacagaaacagcagcaaccugccccugccccugccccccaagaagaccagaaucaucagccacgugugggagaacaacaaccccuuccagaucgugcuggugaagggcaacaagcugaacaccgaggagaccgugaaggugcacgugagagccggccuguuccacggcaccgagcugcugugcaagaccaucgugagcagcgaggugagcggcaagaacgaccacaucuggaacgagccccuggaguucgacaucaacaucugcgaccugcccagaauggccagacugugcuucgccguguacgccgugcuggacaaggugaagaccaagaagagcaccaagaccaucaaccccagcaaguaccagaccaucagaaaggccggcaaggugcacuaccccguggccugggugaacaccaugguguucgacuucaagggccagcugagaaccggcgacaucauccugcacagcuggagcagcuuccccgacgagcuggaggagaugcugaaccccaugggcaccgugcagaccaaccccuacaccgagaacgccaccgcccugcacgugaaguuccccgagaacaagaagcagcccuacuacuacccccccuucgacaagaucaucgagaaggccgccgagaucgccagcagcgacagcgccaacgugagcagcagaggcggcaagaaguuccugcccgugcugaaggagauccuggacagagacccccugagccagcugugcgagaacgagauggaccugaucuggacccugagacaggacugcagagagaucuucccccagagccugcccaagcugcugcugagcaucaaguggaacaagcuggaggacguggcccagcugcaggcccugcugcagaucuggcccaagcugccccccagagaggcccuggagcugcuggacuucaacuaccccgaccaguacgugagagaguacgccgugggcugccugagacagaugagcgacgaggagcugagccaguaccugcugcagcuggugcaggugcugaaguacgagcccuuccuggacugcgcccugagcagauuccugcuggagagagcccugggcaacagaagaaucggccaguuccuguucuggcaccugagaagcgaggugcacauccccgccgugagcgugcaguucggcgugauccuggaggccuacugcagaggcagcgugggccacaugaaggugcugagcaagcagguggaggcccugaacaagcugaagacccugaacagccugaucaagcugaacgccgugaagcugaacagagccaagggcaaggaggccaugcacaccugccugaagcagagcgccuacagagaggcccugagcgaccugcagagcccccugaaccccugcgugauccugagcgagcuguacguggagaagugcaaguacauggacagcaagaugaagccccuguggcugguguacaacaacaagguguucggcgaggacagcgugggcgugaucuucaagaacggcgacgaccugagacaggacaugcugacccugcagaugcugagacugauggaccugcuguggaaggaggccggccuggaccugagaaugcugcccuacggcugccuggccaccggcgacagaagcggccugaucgagguggugagcaccagcgagaccaucgccgacauccagcugaacagcagcaacguggccgccgccgccgccuucaacaaggacgcccugcugaacuggcugaaggaguacaacagcggcgacgaccuggacagagccaucgaggaguucacccugagcugcgccggcuacugcguggccagcuacgugcugggcaucggcgacagacacagcgacaacaucauggugaagaagaccggccagcuguuccacaucgacuucggccacauccugggcaacuucaagagcaaguucggcaucaagagagagagagugcccuucauccugaccuacgacuucauccacgugauccagcagggcaagaccggcaacaccgagaaguucggcagauucagacagugcugcgaggacgccuaccugauccugagaagacacggcaaccuguucaucacccuguucgcccugaugcugaccgccggccugcccgagcugaccagcgugaaggacauccaguaccugaaggacagccuggcccugggcaagagcgaggaggaggcccugaagcaguucaagcagaaguucgacgaggcccugagagagagcuggaccaccaaggugaacuggauggcccacaccgugagaaaggacuacagaagcuga

SEQ ID NO: 9220 - RNA, 3213 nt, Artificial Sequence
  derived and/or modified sequence opt5 from PI3K__Homo_sapiens__AAB29081
augugcuucagcuuuaucaugcccccugccauggcugacauucuggauaucugggccguggacucccagauugcgucugauggcagcaucccggucgacuuccuccugcccaccgggauuuacauccaacuugagguuccuagagaagcuacaaucuccuauauuaagcagaugcuguggaaacaggugcacaacuaccccauguuuaaucuccugauggauaucgacucuuauauguucgccugugugaaccagacggccgucuacgaggaacuugaggaugaaacccggcgccugugcgacgugagaccuuuucuccccguucugaagcuggugacacggagcugugauccuggagagaaacucgacuccaagauuggcguccugaucgggaaaggacuucaugaguucgauucucugaaggacccggaagugaaugaguuucgcagaaagaugcggaaauucagcgaagagaagauucucucccugguuggccuuagcuggauggauuggcugaaacaaaccuaucccccugagcacgaacccucuaucccugagaaccucgaagacaagcuguacgggggaaaacugauuguggcuguccauuuugagaauugccaggacguguucuccuuucaggugagccccaacaugaauccgaucaaggucaacgaacucgccauccagaagcgccugacaauucacggcaaagaggaugagguuucuccuuaugacuacgugcuucaaguguccggcagagucgaauacguguucggggaucauccccugauccaguuucaguauauucggaauuguguuaugaaccgcgcucucccucacuucauccugguggagugcuguaagauuaaaaagauguacgaacaggagaugaucgccaucgaagcggccauuaauagaaacagcucuaaucuuccccugccccucccuccgaaaaagacccggaucauuucccacgucugggagaacaauaaccccuuccaaaucgugcugguuaaaggaaacaagcugaauacagaggaaaccgugaagguccaugugcgcgcuggccucuuucacgggacggagcugcuuugcaaaaccauugucagcuccgaagugucuggaaagaacgaccauaucuggaaugagccucuggaguucgauaucaacauuugugaccuccccagaauggcccggcugugcuuugcuguuuaugccgugcuugauaaagucaagaccaaaaagagcacaaagacaaucaauccuuccaaauaccagaccauucgcaaggcgggcaaagugcacuaucccguugccugggugaacacgauggucuucgacuuuaaggggcagcugagaacaggagauaucauucuccacagcuggucuuccuucccggacgaacuggaggaaaugcugaauccuaugggcaccgugcaaacaaaccccuacaccgagaaugcuaccgcccuccaugugaaauuuccugaaaacaagaagcagcccuauuacuacccucccuucgauaaaaucauugagaaggcugccgagaucgccagcucugacagcgcuaauguuuccucucggggcgggaaaaaguuucugccgguccuuaaagaaauccuggacagagauccucucagccagcugugugagaacgaaauggaccugauuuggacacuucgccaggauugccgggagaucuucccccaaucccuccccaagcugcugcucagcauuaaguggaauaaacuggaagacguggcgcagcuucaggcccugcuccagaucuggccuaagcugccgcccagagaggcucuggagcuucucgauuuuaacuauccugaccaauacgugcgcgaauaugccgucggaugccugcggcagaugucugaugaggaacugucccaguaccuccugcagcuugugcaaguucugaaauaugagcccuuccucgacugugcccugagcagauuucugcuugaacgcgcucucggcaaucggagaauugggcaguuccuguucuggcaucugcgcucugaggugcacaucccugccgucuccgugcaguuuggaguuauccucgaggcguacugccggggcagcguggggcacaugaagguccuguccaaacagguggaagcucuuaacaagcugaaaacgcucaacucucugauuaagcugaaugccguuaagcugaacagagccaaaggaaaggaggcuaugcauaccugucucaaacaaagcgccuaucgcgaagcucuguccgaucugcagucuccccucaauccuugcgugauccugagcgagcuuuacgucgaaaaguguaaauacauggacuccaagaugaagccccuguggcucguguauaacaauaaaguguucggcgaggauagcgucggcguuauuuuuaagaacggggacgaucugcggcaggacaugcugacacuucaaaugcugagacucauggaccugcucuggaaagaggccggacuggaucuucggaugcugccguacggcugccucgcgaccggggaccgcucuggacugaucgaagugguguccacaagcgagaccauugccgauauccagcuuaauucuuccaacgucgcugccgcugccgcguucaauaaggacgcccuucugaacuggcucaaagaauauaauagcggcgaugaccuggauagagcuaucgaggaguuuacgcucucuugugccggguacugcguggcuagcuauguucugggcauuggagaccggcacuccgauaacaucauggugaagaagacaggccagcuuuuccacauugacuuugggcauauccugggaaauuucaaaagcaaguuuggcauuaaaagagaacgcgucccuuucauccucaccuacgauuuuauccacgugauucagcaagggaagaccggaaacacagagaaauucggccgguuuagacaguguugcgaagacgccuaucugauccugcgcagacaugggaaucuuuucauuacccuguucgcccucaugcugacagcuggccuccccgagcugacgucuguuaaggauauccaguaccuuaaggacucccuggcgcugggaaaaagcgaagaggaggcccucaagcaguuuaaacaaaaguucgacgaagcucugcgggaguccuggaccacaaaagugaacuggauggcccacaccguccgcaaggauuacagaucuuga

SEQ ID NO: 9221 - protein, 1102 aa, Artificial Sequence
  PI3K__Homo_sapiens__P48736
MELENYKQPVVLREDNCRRRRRMKPRSAAASLSSMELIPIEFVLPTSQRKCKSPETALLHVAGHGNVEQMKAQVWLRALETSVAADFYHRLGPHHFLLLYQKKGQWYEIYDKYQVVQTLDCLRYWKATHRSPGQIHLVQRHPPSEESQAFQRQLTALIGYDVTDVSNVHDDELEFTRRGLVTPRMAEVASRDPKLYAMHPWVTSKPLPEYLWKKIANNCIFIVIHRSTTSQTIKVSPDDTPGAILQSFFTKMAKKKSLMDIPESQSEQDFVLRVCGRDEYLVGETPIKNFQWVRHCLKNGEEIHVVLDTPPDPALDEVRKEEWPLVDDCTGVTGYHEQLTIHGKDHESVFTVSLWDCDRKFRVKIRGIDIPVLPRNTDLTVFVEANIQHGQQVLCQRRTSPKPFTEEVLWNVWLEFSIKIKDLPKGALLNLQIYCGKAPALSSKASAESPSSESKGKVQLLYYVNLLLIDHRFLLRRGEYVLHMWQISGKGEDQGSFNADKLTSATNPDKENSMSISILLDNYCHPIALPKHQPTPDPEGDRVRAEMPNQLRKQLEAIIATDPLNPLTAEDKELLWHFRYESLKHPKAYPKLFSSVKWGQQEIVAKTYQLLARREVWDQSALDVGLTMQLLDCNFSDENVRAIAVQKLESLEDDDVLHYLLQLVQAVKFEPYHDSALARFLLKRGLRNKRIGHFLFWFLRSEIAQSRHYQQRFAVILEAYLRGCGTAMLHDFTQQVQVIEMLQKVTLDIKSLSAEKYDVSSQVISQLKQKLENLQNSQLPESFRVPYDPGLKAGALAIEKCKVMASKKKPLWLEFKCADPTALSNETIGIIFKHGDDLRQDMLILQILRIMESIWETESLDLCLLPYGCISTGDKIGMIEIVKDATTIAKIQQSTVGNTGAFKDEVLNHWLKEKSPTEEKFQAAVERFVYSCAGYCVATFVLGIGDRHNDNIMITETGNLFHIDFGHILGNYKSFLGINKERVPFVLTPDFLFVMGTSGKKTSPHFQKFQDICVKAYLALRHHTNLLIILFSMMLMTGMPQLTSKEDIEYIRDALTVGKNEEDAKKYFLDQIEVCRDKGWTVQFNWFLHLVLGIKQGEKHSA

SEQ ID NO: 9222 - RNA, 3309 nt, Artificial Sequence
  PI3K__Homo_sapiens__AAH35683
auggagcuggagaacuauaaacagcccguggugcugagagaggacaacugccgaaggcgccggaggaugaagccgcgcagugcugcggccagccuguccuccauggagcucauccccaucgaguucgugcugcccaccagccagcgcaaaugcaagagccccgaaacggcgcugcugcacguggccggccacggcaacguggagcagaugaaggcccagguguggcugcgagcgcuggagaccagcguggcggcggacuucuaccaccggcugggaccgcaucacuuccuccugcucuaucagaagaaggggcagugguacgagaucuacgacaaguaccagguggugcagacucuggacugccugcgcuacuggaaggccacgcaccggagcccgggccagauccaccuggugcagcggcacccgcccuccgaggagucccaagccuuccagcggcagcucacggcgcugauuggcuaugacgucacugacgucagcaacgugcacgacgaugagcuggaguucacgcgccguggcuuggugaccccgcgcauggcggagguggccagccgcgaccccaagcucuacgccaugcacccgugggugacguccaagccccucccggaguaccuguggaagaagauugccaacaacugcaucuucaucgucauucaccgcagcaccaccagccagaccauuaaggucucacccgacgacacccccggcgccauccugcagagcuucuucaccaagauggccaagaagaaaucucugauggauauucccgaaagccaaagcgaacaggauuuugugcugcgcgucuguggccgggaugaguaccuggugggcgaaacgcccaucaaaaacuuccagugggugaggcacugccucaagaacggagaagagauucacgugguacuggacacgccuccagacccggcccuagacgaggugaggaaggaagaguggccgcugguggacgacugcacgggagucaccggcuaccaugagcagcuuaccauccacggcaaggaccacgagaguguguucaccgugucccugugggacugcgaccgcaaguucagggucaagaucagaggcauugauauccccguccugccucggaacaccgaccucacaguuuuuguagaggcaaacauccagcaugggcaacaaguccuuugccaaaggagaaccagccccaaacccuucacagaggaggugcuguggaauguguggcuugaguucaguaucaaaaucaaagacuugcccaaaggggcucuacugaaccuccagaucuacugcgguaaagcuccagcacuguccagcaaggccucugcagagucccccaguucugaguccaagggcaaaguucagcuucucuauuaugugaaccugcugcugauagaccaccguuuccuccugcgccguggagaauacguccuccacauguggcagauaucugggaagggagaagaccaaggaagcuucaaugcugacaaacucacgucugcaacuaacccagacaaggagaacucaauguccaucuccauucuucuggacaauuacugccacccgauagcccugccuaagcaucagcccaccccugacccggaaggggaccggguucgagcagaaaugcccaaccagcuucgcaagcaauuggaggcgaucauagccacugauccacuuaacccucucacagcagaggacaaagaauugcucuggcauuuuagauacgaaagccuuaagcacccaaaagcauauccuaagcuauuuaguucagugaaauggggacagcaagaaauuguggccaaaacauaccaauuguuggccagaagggaagucugggaucaaagugcuuuggauguuggguuaacaaugcagcuccuggacugcaacuucucagaugaaaauguaagagccauugcaguucagaaacuggagagcuuggaggacgaugauguucugcauuaccuucuacaauugguccaggcugugaaauuugaaccauaccaugauagugcccuugccagauuucugcugaagcgugguuuaagaaacaaaagaauuggucacuuuuuguuuugguucuugagaagugagauagcccaguccagacacuaucagcagagguucgcugugauucuggaagccuaucugaggggcuguggcacagccaugcugcacgacuuuacccaacaaguccaaguaaucgagauguuacaaaaagucacccuugauauuaaaucgcucucugcugaaaaguaugacgucaguucccaaguuauuucacaacuuaaacaaaagcuugaaaaccugcagaauucucaacuccccgaaagcuuuagaguuccauaugauccuggacugaaagcaggagcgcuggcaauugaaaaauguaaaguaauggccuccaagaaaaaaccacuauggcuugaguuuaaaugugccgauccuacagcccuaucaaaugaaacaauuggaauuaucuuuaaacauggugaugaucugcgccaagacaugcuuauuuuacagauucuacgaaucauggagucuauuugggagacugaaucuuuggaucuaugccuccugccauaugguugcauuucaacuggugacaaaauaggaaugaucgagauugugaaagacgccacgacaauugccaaaauucagcaaagcacagugggcaacacgggagcauuuaaagaugaaguccugaaucacuggcucaaagaaaaauccccuacugaagaaaaguuucaggcagcaguggagagauuuguuuauuccugugcaggcuacuguguggcaaccuuuguucuuggaauaggcgacagacacaaugacaauauuaugaucaccgagacaggaaaccuauuucauauugacuucgggcacauucuugggaauuacaaaaguuuccugggcauuaauaaagagagagugccauuugugcuaaccccugacuuccucuuugugaugggaacuucuggaaagaagacaagcccacacuuccagaaauuucaggacaucuguguuaaggcuuaucuagcccuucgucaucacacaaaccuacugaucauccuguucuccaugaugcugaugacaggaaugccccaguuaacaagcaaagaagacauugaauauauccgggaugcccucacaguggggaaaaaugaggaggaugcuaaaaaguauuuucuugaucagaucgaaguuugcagagacaaaggauggacugugcaguuuaauugguuucuacaucuuguucuuggcaucaaacaaggagagaaacauucagccuaa

SEQ ID NO: 9223 - RNA, 3309 nt, Artificial Sequence
  derived and/or modified sequence opt1 from PI3K__Homo_sapiens__AAH35683
auggagcuggagaacuacaagcagcccgugguccuccgcgaggacaacugccggcgccggcgccggaugaagccgcgcagcgccgccgcgucccugagcuccauggagcugauccccaucgaguucgugcuccccaccagccagcggaagugcaagucccccgagaccgcccugcugcacguggccggccacgggaacgucgagcagaugaaggcccagguguggcuccgcgcccuggagacgagcguggcggccgacuucuaccaccggcugggcccgcaccacuuccuccugcuguaccagaagaaggggcagugguacgagaucuacgacaaguaccaggucgugcagacccucgacugccugcgcuacuggaaggccacccaccggucccccggccagauccaccuggugcagcgccacccgcccagcgaggagucccaggccuuccagcggcagcucaccgcgcugaucggguacgacgucacggacgugagcaacgugcacgacgacgagcuggaguucacccgccggggccucgucacgccccgcauggccgagguggccucccgggaccccaagcuguacgccaugcaccccugggugaccagcaagccccugccggaguaccucuggaagaagaucgccaacaacugcaucuucaucgucauccaccgcuccaccaccagccagaccaucaaggugucccccgacgacacccccggcgcgauccugcagagcuucuucacgaagauggccaagaagaagucccugauggacauccccgagagccaguccgagcaggacuucgugcuccgggucugcgggcgcgacgaguaccuggugggcgagaccccgaucaagaacuuccagugggugcggcacugccugaagaacggggaggagauccacgucgugcucgacaccccgcccgaccccgcccuggacgaggugcgcaaggaggaguggccccuggucgacgacugcaccggcgugacgggguaccacgagcagcucaccauccacggcaaggaccacgagagcgucuucaccgugagccugugggacugcgaccgcaaguuccgggugaagauccgcggcaucgacauccccguccugccccggaacaccgaccucacgguguucguggaggccaacauccagcacgggcagcagguccugugccagcgccggaccucccccaagccguucaccgaggaggugcuguggaacguguggcucgaguucagcaucaagaucaaggaccugcccaagggcgcccugcucaaccugcagaucuacugcgggaaggcgcccgcccuguccagcaaggccuccgccgagagccccuccagcgaguccaagggcaagguccagcuccuguacuacgugaaccugcuccugaucgaccaccgcuuccugcuccggcgcggcgaguacgugcugcacauguggcagaucagcgggaagggcgaggaccagggguccuucaacgccgacaagcugaccagcgcgacgaacccggacaaggagaacuccaugagcaucuccauccugcucgacaacuacugccaccccaucgcccugcccaagcaccagccgacccccgaccccgagggcgaccggguccgcgccgagaugcccaaccagcugcggaagcagcucgaggccaucaucgccaccgacccgcugaacccccugaccgcggaggacaaggagcuccuguggcacuuccgcuacgagagccugaagcaccccaaggccuaccccaagcuguucuccagcgugaagugggggcagcaggagaucguggccaagacguaccagcuccuggcccggcgcgaggucugggaccaguccgcgcucgacgugggccugaccaugcagcugcucgacugcaacuucagcgacgagaacgugcgggccaucgccguccagaagcuggagagccuggaggacgacgacgugcuccacuaccugcugcagcucgugcaggccgucaaguucgagccguaccacgacuccgcccuggcgcgcuuccugcucaagcggggccugcgcaacaagcggaucgggcacuuccuguucugguuccuccgcagcgagaucgcccagucccgccacuaccagcagcgguucgccgugauccuggaggccuaccugcgcggcugcgggaccgccaugcuccacgacuucacccagcagguccaggugaucgagaugcugcagaaggugacgcuggacaucaagagccucuccgcggagaaguacgacgugagcucccaggucaucagccagcugaagcagaagcuggagaaccuccagaacucccagcugcccgagagcuuccgggugcccuacgaccccggccugaaggccggggcccucgccaucgagaagugcaaggugauggccuccaagaagaagccgcuguggcuggaguucaagugcgcggaccccaccgcccucagcaacgagaccaucggcaucaucuucaagcacggcgacgaccugcgccaggacaugcugauccuccagauccugcggaucauggaguccaucugggagaccgagagccuggaccucugccugcugcccuacgggugcaucuccacgggcgacaagaucgggaugaucgagaucgucaaggacgccaccaccaucgccaagauccagcagagcaccgugggcaacaccggggcguucaaggacgaggugcucaaccacuggcugaaggagaagucccccacggaggagaaguuccaggccgccgucgagcgcuucguguacagcugcgccggcuacugcguggccaccuucguccugggcaucggggaccggcacaacgacaacaucaugaucaccgagaccggcaaccucuuccacaucgacuucgggcacauccugggcaacuacaagagcuuccugggcaucaacaaggagcgcgugccguucgugcucacgcccgacuuccuguucgucauggggaccuccggcaagaagaccagcccccacuuccagaaguuccaggacaucugcgugaaggcguaccuggcccuccggcaccacaccaaccugcugaucauccucuucuccaugaugcugaugacggggaugccccagcugaccagcaaggaggacaucgaguacauccgcgacgcccucaccgugggcaagaacgaggaggacgccaagaaguacuuccuggaccagaucgaggucugccgggacaagggguggaccgugcaguucaacugguuccugcaccucgugcugggcaucaagcagggcgagaagcacuccgccuga

SEQ ID NO: 9224 - RNA, 3309 nt, Artificial Sequence
  derived and/or modified sequence opt2 from PI3K__Homo_sapiens__AAH35683
auggagcucgagaacuacaagcagcccgucguccuccgcgaggacaacugccgccgccgccgccgcaugaagccccgcuccgccgccgccucccucuccuccauggagcucauccccaucgaguucguccuccccaccucccagcgcaagugcaagucccccgagaccgcccuccuccacgucgccggccacggcaacgucgagcagaugaaggcccaggucuggcuccgcgcccucgagaccuccgucgccgccgacuucuaccaccgccucggcccccaccacuuccuccuccucuaccagaagaagggccagugguacgagaucuacgacaaguaccaggucguccagacccucgacugccuccgcuacuggaaggccacccaccgcucccccggccagauccaccucguccagcgccacccccccuccgaggagucccaggccuuccagcgccagcucaccgcccucaucggcuacgacgucaccgacgucuccaacguccacgacgacgagcucgaguucacccgccgcggccucgucaccccccgcauggccgaggucgccucccgcgaccccaagcucuacgccaugcaccccugggucaccuccaagccccuccccgaguaccucuggaagaagaucgccaacaacugcaucuucaucgucauccaccgcuccaccaccucccagaccaucaaggucucccccgacgacacccccggcgccauccuccaguccuucuucaccaagauggccaagaagaagucccucauggacauccccgagucccaguccgagcaggacuucguccuccgcgucugcggccgcgacgaguaccucgucggcgagacccccaucaagaacuuccaguggguccgccacugccucaagaacggcgaggagauccacgucguccucgacaccccccccgaccccgcccucgacgagguccgcaaggaggaguggccccucgucgacgacugcaccggcgucaccggcuaccacgagcagcucaccauccacggcaaggaccacgaguccgucuucaccgucucccucugggacugcgaccgcaaguuccgcgucaagauccgcggcaucgacauccccguccucccccgcaacaccgaccucaccgucuucgucgaggccaacauccagcacggccagcagguccucugccagcgccgcaccucccccaagcccuucaccgaggagguccucuggaacgucuggcucgaguucuccaucaagaucaaggaccuccccaagggcgcccuccucaaccuccagaucuacugcggcaaggcccccgcccucuccuccaaggccuccgccgagucccccuccuccgaguccaagggcaagguccagcuccucuacuacgucaaccuccuccucaucgaccaccgcuuccuccuccgccgcggcgaguacguccuccacauguggcagaucuccggcaagggcgaggaccagggcuccuucaacgccgacaagcucaccuccgccaccaaccccgacaaggagaacuccauguccaucuccauccuccucgacaacuacugccaccccaucgcccuccccaagcaccagcccacccccgaccccgagggcgaccgcguccgcgccgagaugcccaaccagcuccgcaagcagcucgaggccaucaucgccaccgacccccucaacccccucaccgccgaggacaaggagcuccucuggcacuuccgcuacgagucccucaagcaccccaaggccuaccccaagcucuucuccuccgucaaguggggccagcaggagaucgucgccaagaccuaccagcuccucgcccgccgcgaggucugggaccaguccgcccucgacgucggccucaccaugcagcuccucgacugcaacuucuccgacgagaacguccgcgccaucgccguccagaagcucgagucccucgaggacgacgacguccuccacuaccuccuccagcucguccaggccgucaaguucgagcccuaccacgacuccgcccucgcccgcuuccuccucaagcgcggccuccgcaacaagcgcaucggccacuuccucuucugguuccuccgcuccgagaucgcccagucccgccacuaccagcagcgcuucgccgucauccucgaggccuaccuccgcggcugcggcaccgccaugcuccacgacuucacccagcagguccaggucaucgagaugcuccagaaggucacccucgacaucaagucccucuccgccgagaaguacgacgucuccucccaggucaucucccagcucaagcagaagcucgagaaccuccagaacucccagcuccccgaguccuuccgcguccccuacgaccccggccucaaggccggcgcccucgccaucgagaagugcaaggucauggccuccaagaagaagccccucuggcucgaguucaagugcgccgaccccaccgcccucuccaacgagaccaucggcaucaucuucaagcacggcgacgaccuccgccaggacaugcucauccuccagauccuccgcaucauggaguccaucugggagaccgagucccucgaccucugccuccuccccuacggcugcaucuccaccggcgacaagaucggcaugaucgagaucgucaaggacgccaccaccaucgccaagauccagcaguccaccgucggcaacaccggcgccuucaaggacgagguccucaaccacuggcucaaggagaagucccccaccgaggagaaguuccaggccgccgucgagcgcuucgucuacuccugcgccggcuacugcgucgccaccuucguccucggcaucggcgaccgccacaacgacaacaucaugaucaccgagaccggcaaccucuuccacaucgacuucggccacauccucggcaacuacaaguccuuccucggcaucaacaaggagcgcguccccuucguccucacccccgacuuccucuucgucaugggcaccuccggcaagaagaccuccccccacuuccagaaguuccaggacaucugcgucaaggccuaccucgcccuccgccaccacaccaaccuccucaucauccucuucuccaugaugcucaugaccggcaugccccagcucaccuccaaggaggacaucgaguacauccgcgacgcccucaccgucggcaagaacgaggaggacgccaagaaguacuuccucgaccagaucgaggucugccgcgacaagggcuggaccguccaguucaacugguuccuccaccucguccucggcaucaagcagggcgagaagcacuccgccuga

SEQ ID NO: 9225 - RNA, 3309 nt, Artificial Sequence
  derived and/or modified sequence opt3 from PI3K__Homo_sapiens__AAH35683
auggagcuggaaaacuacaagcagcccgugguccucagagaggacaauugcaggcggcgccgacguaugaaaccuagaagcgccgcugcaucccuuucuucaauggaacugaucccaauugaguucguuuugccgaccagucaaaggaaguguaaaagccccgaaacagccuuacugcacguggcgggccaugggaacguagagcagaugaaggcucagguguggcuacgggcccucgagacuuccgucgcagccgauuuuuaucaccgccugggaccucaucacuuccuucuguuguaccagaaaaagggucaaugguaugaaauauacgacaaguaucaggugguucagacgcucgauugccugagauacuggaaagcuacccauaggucuccaggccagauccaccuggugcaacggcaucccccuucggaggaaucacaggcauuucagcgccagcucacagccuuaauuggguaugacgucacugaugugagcaauguacacgacgaugagcuggaguucacccgaagaggacuuguuacaccaaggauggcugaaguggccagucgggaccccaaguuguacgcgaugcacccuugggucaccuccaaaccacugccggaguaccuauggaagaaaaucgcaaacaauuguauuuuuaucgugauacaucguucuacuacaagccaaaccaucaaggugucccccgaugacacgccuggcgccauucuccagucauucuuuacuaagauggcuaaaaagaaaagucugauggauaucccagaaagccagucugagcaagacuucguccuucgcguuugcgguagagaugaauaucuggugggggagacccccauuaagaacuuucaguggguaaggcacuguuugaaaaauggagaggaaauccacgugguccucgacacaccuccagaccccgcccuggaugaggugcggaaggaagaguggccguuaguugacgauugcacuggcgugaccggcuaccaugaacagcugacaauacacgggaaagaccaugaguccgucuucaccgugucacucugggauugugaccgaaaguuucgcguaaagauuagaggaaucgauauuccuguucuucccaggaacacggaccugacuguguucgucgaggcaaauauccagcacggucaacagguguugugccagcggcgcacaagcccaaaaccuuuuaccgaagagguccuauggaacguguggcuggaguucaguaucaagauuaaagaucuccccaagggcgcucugcuuaaucugcagauauauugugggaaagccccagcguugucuuccaaggccagcgcagaaucgcccucuuccgaaucaaagggaaaaguucaacuccuguacuaugugaacuuacugcuaaucgaccauagauuccuccugaggcguggcgaguacguacuucacauguggcagauuagugguaagggggaggaucagggcagcuuuaaugcugacaaauugacuuccgccacaaacccugacaaggaaaauucuaugagcaucucaauacugcucgauaacuauugccacccaauugcucugccgaaacaucagcccaccccugacccagagggagaucggguccgagccgaaaugcccaaccaacuuagaaagcagcuggaggcaaucaucgccacggacccuuugaauccacucaccgcugaggauaaggaacuguuauggcacuucagguacgagagucugaaacaucccaaggcguacccgaaacuauuuuccagcgugaaguggggccagcaggaaauuguugcaaaaacauaucaacuccuggcccgccgggaggugugggaccagucugcucuugaugucggguugacuaugcagcugcucgacuguaacuucucagaugaaaaugugagagccaucgcaguacaaaagcuggagaguuuagaggacgaugacgugcugcacuaccuuuugcagcucguucaggccgucaaguuugaaccuuaucacgauagcgcucuggccagguuccuacugaaacgcggacuccgaaacaagcggauuggucauuuucuguucugguuucuucguuccgagauagcacagucuagacacuaccaacagagguucgcggugaucuuggaggcuuaucugcgcggcugcgggaccgccauguuacaugacuuuacacaacaggugcaggucauugaaaugcuccagaaaguuacucuggacaucaagucgcuuagcgcagaaaaauacgauguguccucacaggugaucagucagcugaagcaaaaauuggagaaucuccagaacucucagcugccagagagcuuccggguacccuaugacccuggacuaaaggccggcgcucuggccauugaaaagugcaaagucauggcauccaagaaaaagccccucuggcuggaguuuaaaugugcugauccaaccgcccuuucaaaugaaacaauagguaucauuuucaagcacggggacgauuugagacaagacaugcugaucuuacagauucucaggaucauggagagcauaugggaaaccgagucucuggaucuuugccugcuaccuuacggcuguaucuccacuggagacaagauuggcaugaucgagauugugaaagaugcgacgacaaucgccaagauacagcagaguaccguugggaacacuggagcuuucaaagacgaagugcucaaucauuggcugaaggagaaaagccccaccgaagagaaguuucaagcagccgucgagcgauucguguacucuugcgcugguuauuguguugccacauuuguguugggcauuggggaucgccacaacgacaauaucaugauuaccgaaacuggaaaccuguuccacaucgauuuuggccauauauuagguaauuacaaguccuuccucgggaucaacaaagagcggguaccauuuguccugacaccggacuuccuuuuugugaugggcacgucaggaaagaaaaccaguccucacuuccagaaguuucaggacauuugcgugaaagcauaucuggcguugagacaucacacuaaucuccugaucauucuauucagcaugaugcugaugacaggcaugccccagcuuaccucgaaggaagauaucgaguacauaagggacgcccucacagucgggaagaacgaagaggaugcuaaaaaguauuuucuggaccaaauugagguuugucgugauaaaggauggacugugcaguucaacugguucuugcaucugguauuagguaucaagcagggcgaaaaacacuccgccuga

SEQ ID NO: 9226 - RNA, 3309 nt, Artificial Sequence
  derived and/or modified sequence opt4 from PI3K__Homo_sapiens__AAH35683
auggagcuggagaacuacaagcagcccguggugcugagagaggacaacugcagaagaagaagaagaaugaagcccagaagcgccgccgccagccugagcagcauggagcugauccccaucgaguucgugcugcccaccagccagagaaagugcaagagccccgagaccgcccugcugcacguggccggccacggcaacguggagcagaugaaggcccagguguggcugagagcccuggagaccagcguggccgccgacuucuaccacagacugggcccccaccacuuccugcugcuguaccagaagaagggccagugguacgagaucuacgacaaguaccagguggugcagacccuggacugccugagauacuggaaggccacccacagaagccccggccagauccaccuggugcagagacacccccccagcgaggagagccaggccuuccagagacagcugaccgcccugaucggcuacgacgugaccgacgugagcaacgugcacgacgacgagcuggaguucaccagaagaggccuggugacccccagaauggccgagguggccagcagagaccccaagcuguacgccaugcaccccugggugaccagcaagccccugcccgaguaccuguggaagaagaucgccaacaacugcaucuucaucgugauccacagaagcaccaccagccagaccaucaaggugagccccgacgacacccccggcgccauccugcagagcuucuucaccaagauggccaagaagaagagccugauggacauccccgagagccagagcgagcaggacuucgugcugagagugugcggcagagacgaguaccuggugggcgagacccccaucaagaacuuccagugggugagacacugccugaagaacggcgaggagauccacguggugcuggacaccccccccgaccccgcccuggacgaggugagaaaggaggaguggccccugguggacgacugcaccggcgugaccggcuaccacgagcagcugaccauccacggcaaggaccacgagagcguguucaccgugagccugugggacugcgacagaaaguucagagugaagaucagaggcaucgacauccccgugcugcccagaaacaccgaccugaccguguucguggaggccaacauccagcacggccagcaggugcugugccagagaagaaccagccccaagcccuucaccgaggaggugcuguggaacguguggcuggaguucagcaucaagaucaaggaccugcccaagggcgcccugcugaaccugcagaucuacugcggcaaggcccccgcccugagcagcaaggccagcgccgagagccccagcagcgagagcaagggcaaggugcagcugcuguacuacgugaaccugcugcugaucgaccacagauuccugcugagaagaggcgaguacgugcugcacauguggcagaucagcggcaagggcgaggaccagggcagcuucaacgccgacaagcugaccagcgccaccaaccccgacaaggagaacagcaugagcaucagcauccugcuggacaacuacugccaccccaucgcccugcccaagcaccagcccacccccgaccccgagggcgacagagugagagccgagaugcccaaccagcugagaaagcagcuggaggccaucaucgccaccgacccccugaacccccugaccgccgaggacaaggagcugcuguggcacuucagauacgagagccugaagcaccccaaggccuaccccaagcuguucagcagcgugaaguggggccagcaggagaucguggccaagaccuaccagcugcuggccagaagagaggugugggaccagagcgcccuggacgugggccugaccaugcagcugcuggacugcaacuucagcgacgagaacgugagagccaucgccgugcagaagcuggagagccuggaggacgacgacgugcugcacuaccugcugcagcuggugcaggccgugaaguucgagcccuaccacgacagcgcccuggccagauuccugcugaagagaggccugagaaacaagagaaucggccacuuccuguucugguuccugagaagcgagaucgcccagagcagacacuaccagcagagauucgccgugauccuggaggccuaccugagaggcugcggcaccgccaugcugcacgacuucacccagcaggugcaggugaucgagaugcugcagaaggugacccuggacaucaagagccugagcgccgagaaguacgacgugagcagccaggugaucagccagcugaagcagaagcuggagaaccugcagaacagccagcugcccgagagcuucagagugcccuacgaccccggccugaaggccggcgcccuggccaucgagaagugcaaggugauggccagcaagaagaagccccuguggcuggaguucaagugcgccgaccccaccgcccugagcaacgagaccaucggcaucaucuucaagcacggcgacgaccugagacaggacaugcugauccugcagauccugagaaucauggagagcaucugggagaccgagagccuggaccugugccugcugcccuacggcugcaucagcaccggcgacaagaucggcaugaucgagaucgugaaggacgccaccaccaucgccaagauccagcagagcaccgugggcaacaccggcgccuucaaggacgaggugcugaaccacuggcugaaggagaagagccccaccgaggagaaguuccaggccgccguggagagauucguguacagcugcgccggcuacugcguggccaccuucgugcugggcaucggcgacagacacaacgacaacaucaugaucaccgagaccggcaaccuguuccacaucgacuucggccacauccugggcaacuacaagagcuuccugggcaucaacaaggagagagugcccuucgugcugacccccgacuuccuguucgugaugggcaccagcggcaagaagaccagcccccacuuccagaaguuccaggacaucugcgugaaggccuaccuggcccugagacaccacaccaaccugcugaucauccuguucagcaugaugcugaugaccggcaugccccagcugaccagcaaggaggacaucgaguacaucagagacgcccugaccgugggcaagaacgaggaggacgccaagaaguacuuccuggaccagaucgaggugugcagagacaagggcuggaccgugcaguucaacugguuccugcaccuggugcugggcaucaagcagggcgagaagcacagcgccuga

SEQ ID NO: 9227 - RNA, 3309 nt, Artificial Sequence
  derived and/or modified sequence opt5 from PI3K__Homo_sapiens__AAH35683
auggagcuggaaaacuacaagcagcccgugguccucagagaggacaauugccggcgcagacggcgcaugaaaccuagaagcgccgcugccucccugucuagcauggaacuuaucccgauugaguucguucugcccaccucccaacggaaguguaaaucuccugaaacagcgcuccugcacguggcuggccaugggaacguggagcagaugaaggcccaggucuggcuucgcgcccuggagacgagcguggcugccgauuuuuaucacagacucggaccccaucacuuccugcugcucuaccagaaaaagggccaaugguaugaaaucuacgacaaguaucagguugugcagacccuggauugccuucgguacuggaaagcuacacaucgcuccccugggcagauucaccugguccaaagacaucccccuucugaggaaagccaggccuuucagcggcagcucaccgcgcugaucggauaugacgugacagauguuuccaaugugcacgacgaugagcuugaguucacccgcagaggccuggucacaccgcggauggccgaaguggcuagccgcgaccccaagcucuacgccaugcacccuugggugaccucuaaaccccugccugaguaccuguggaagaaaauugcuaacaauuguaucuuuaucgucauucauagauccacgaccagccaaacaaucaagguuucucccgaugacaccccgggggccauucuccaguccuucuuuacaaagauggcgaaaaagaaaagccugauggauaucccugaaucucaguccgagcaagacuucgugcuucgggugugcggaagagaugaauaucuggucggcgagacccccauuaagaacuuucagugggugcgccacugucucaaaaauggcgaggaaauccacguugugcuggacacgccucccgaccccgcccuugaugagguccggaaggaagaguggccucugguggacgauugcacagggguuaccggauaccaugaacagcucacaauucacggcaaagaccaugagagcguguucaccgucucccugugggauugugacagaaaguuucgcgugaagauccgggggaucgauauuccgguccugcccagaaacaccgaccucacaguguucguugaggcuaauauccagcacggacaacaggugcugugccagcgccggacgucuccuaaacccuuuaccgaagagguccuuuggaacguguggcuggaguucagcauuaagaucaaagaucucccuaagggcgcccugcuuaaucugcagauuuauugugggaaagcucccgcccucuccagcaaggccucugcugaauccccgagcucugaaagcaagggaaaaguucaacugcuguacuaugugaaccuccugcuuaucgaccauagauuccugcuccgccggggcgaguacguccugcacauguggcagaucuccggcaagggggaggaucagggaucuuuuaaugcggacaaacugacaagcgccaccaacccugacaaggaaaauuccaugagcauuucuauccuucucgauaacuauugccaccccauugcucugccuaaacaucagcccacaccugaccccgagggcgauagagugcgcgccgaaaugccgaaccaacugcggaagcagcucgaggccaucauugcuaccgacccucugaauccccuuacggccgaggauaaggaacugcucuggcacuucagauacgagucccugaaacaucccaaggcguacccuaaacuguuuagcucugugaagugggggcagcaggaaaucguugcuaaaacauaucaacuucucgcccggcgcgaggucugggaccaguccgcccuggaugugggacugaccaugcagcuccuggacuguaacuucagcgaugaaaaugugagagcuaucgccguccaaaaacuugagucccuggaggacgaugacgugcuccacuaccugcugcagcuuguucaggcugugaaguuugaaccguaucacgauucugcccucgcgcgguuccugcugaaaagaggccuccgcaacaagcggauugggcauuuucuguucugguuucuuagaagcgagaucgcccagucccgccacuaccaacagagauucgcugucauucuggaagccuaucuccggggaugcggcaccgcuaugcugcaugacuuuacacaacaggugcagguuaucgagaugcugcagaaagugacccuugacauuaagucucucagcgccgaaaaauacgaugucuccagccaggugaucucucagcugaagcaaaaacuggagaaucuccagaacucccagcugcccgagagcuuccgcguuccuuaugaccccggccuuaaggcgggggcccuggcuauugaaaagugcaaagugauggccucuaagaaaaagccucucuggcuggaguuuaaaugugcugaucccacagcccuguccaaugaaacgaucggaaucauuuucaagcacggcgacgaucuuagacaagacaugcugauccuccagauucugcggaucauggagagcauuugggaaaccgagucucucgaucugugccuucugccuuacggguguaucagcacaggagacaagaucggcaugauugagaucgucaaagaugccaccacaauugcuaagauccagcaguccaccguggggaacacgggcgcguucaaagacgaagugcucaaucauuggcugaaggagaaaagccccaccgaagagaaguuucaagccgcugucgagcgcuucguuuacucuugcgccggauauuguguggccacauuugugcugggcauuggggauagacacaacgacaauaucaugaucaccgaaacaggaaaccuuuuccacauugauuuuggccauauccuggggaauuacaaguccuuccucggaauuaacaaagagcgggucccguuugugcugaccccugacuuccucuuuguuaugggcacgagcgggaagaaaacaucuccccacuuccagaaguuucaggacaucugcgugaaggcuuaucuggcccuucgccaucacaccaaucugcucauuauccuguucuccaugaugcugaugacaggcaugccucagcuuaccagcaaggaagauaucgaguacauuagagacgcgcugaccgucggaaagaacgaagaggaugcuaaaaaguauuuucucgaccaaaucgaggugugucgggauaaaggcuggacaguucaguucaacugguuccugcaucucgugcuggggauuaagcagggagaaaaacacuccgccuga

SEQ ID NO: 9228 - protein, 754 aa, Artificial Sequence
  PI3K__Homo_sapiens__Q5UE93
MESSDVELDLQRSVQAVLRELSTQAPALQSNQGMWRWSLHKKVERDPGKSPVLVRILLRELEKAESQDLRHVIIPLLHTVMYVLTKATGITEELYQRIYAFCTRLLTLPTPYCTVALDCAIRLKTEMAVPGTLYQRMVIAEQNLTNELYPYQERVFLFVDPELVSASVCSALLLEIEAAQAQQTPETCMRHVVSHALQAALGEACHAGALHRKLQASPRRTLEHYFHAVVAALEQMASEASPSREGHVERLEEIYCSLLGPAAGRCGGDLVQERPPSIPLPSPYITFHLWTGEEQLWKELVLFLRPRSQLRLSADLEVLDLQGLRPDRELARVSVLSTDSGIERDLPTGADELPAPGSPEMERAGLQRKGGIKKRAWPLDFLMPGSWDGPPGLHRRTGRPSGDGEMLPGVSRLHTARVLVLGDDRMLGRLAQAYHRLRKRETQKFCLTPRLSLQLYYIPVLAPEKPAASRQPELGELATFLGRVDPWYQSNVNTLCPAIHKLAEMPPSLDTSRTVDPFILDVITYYIRMGTQPIYFQIYTVKIFFSDLSQDPTEDIFLIELKVKIQDSKFPKDGFSPRRRGVAEGPGAELSLCYQKALLSHRPREVTVSLRATGLILKAIPASDTEVSGSSHCPLPAAPVTDHTCLNVNVTEVVKSSNLAGKSFSTVTNTFRTNNIQIQSRDQRLLTLSLDKDDQRTFRDVVRFEVAPCPEPCSGAQKSKAPWLNLHGQQEVEAIKAKPKPLLMPINTFSGIVQ

SEQ ID NO: 9229 - RNA, 2265 nt, Artificial Sequence
  PI3K__Homo_sapiens__AAV30085
auggagagcucagauguggagcuggaccuccagaggagcgugcaggcugugcuccgggagcucagcacccaggccccugcccugcagagcaaccaaggcauguggagguggucccugcacaagaaggucgagcgagaucccgguaagagcccagugcugguccgcauucuucucagagaacuggagaaggcggaaagccaggaccuccggcaugucaucauucccuugcugcacacuguaauguacgugcucaccaaggccacaggaaucacagaagagcucuaccagagaaucuaugccuuuugcacaagguuacugacccugcccacccccuacugcacagucgccuuggacugcgcgauaaggcugaaaacggagauggcugucccagggacacuguaccaaaggauggucauugccgaacagaacuugacgaaugagcuguaucccuaccaggagagaguguuccucuucguggauccugagcuggugucugcgucugugugcagugcucugcuacuggagaucgaggcggcccaggcgcagcagacaccagagaccugcaugcgccacguggucucccacgcccugcaggcggcucugggggaggccugucacgcaggcgcucugcacaggaagcugcaggccagcccucgccgcacccuggagcacuauuuccacgccgugguggccgccuuggagcagauggccagcgaggccagcccgagccgggagggacacguagagaggcuggaggagauuuacugcucgcugcugggucccgcggcggggcgcugcgguggugaccuuguccaagagcggccaccaagcauuccccugcccagccccuacaucaccuuccacuuguggaccggugaggagcagcucuggaaggaacuggugcucuuccuccgcccaagaucccagcugcgccucagugcugacuuggaggucuuggaucugcagggccuccggccggaccgggaguuggcccggguuucugugcuguccacugacagcggcauugagcgggaccuucccacgggggcugaugagcugccugcacccggcagcccugagauggagcgagccgggcugcagcgcaaagggggcaucaagaagcgugcauggccccuggacuucuugaugccuggcagcugggacgggcccccagggcugcaccggaggacaggccggcccaguggggauggggaaaugcugcccggcgugucccggcugcacacagcccggguacuugugcucggagaugacaggaugcuggggcgccuggcccaggccuaccacagacucaggaaacgggagacccagaaguucugccucacucccagacucagccugcagcucuacuacauccccgugcuggcgccugagaagccugcagcauccaggcagccggagcugggagagcuggcuacguuccugggccgcguagacccgugguaccagagcaacgucaacacgcugugccccgccauccacaagcuggcugagaugccuccuucccuggacacaucccggacuguggaccccuucauccuagacgucaucaccuacuacauccgcaugggcacccaacccaucuauuuccagaucuacacagucaagaucuuuuucagugaccugagccaagacccuacugaggacauuuuccucauugaacugaaggugaagauccaagauucuaaauuccccaaagauggcuuuucacccaggaggagaggcguggcugagggcccaggggcagagcucucccuaugcuaccagaaggccuugcuuagccaccggccccgagaggucaccguuucccugcgggccacugggcugauccugaaggccauuccagccagcgacacagaaguuucagggucuagccauugcccccugccugcugcuccugucacagaccacacaugucugaaugucaacgugacagagguugucaaguccuccaacuuggcgggaaaguccuucucuacagugaccaacaccuucaggacgaacaauauccagauccagagccgggaccagaggcugcugacacugucgcuggacaaggacgaucaacgcacuuucagggauguggucagauucgagguugcucccugcccagaaccauguucuggggcccagaaguccaaggcaccguggcucaauuugcaugggcaacaggagguggaagcaaucaaagccaagcccaagccccuucugaugcccaucaacacauucucugguauuguccaguga

SEQ ID NO: 9230 - RNA, 2265 nt, Artificial Sequence
  derived and/or modified sequence opt1 from PI3K__Homo_sapiens__AAV30085
auggagagcuccgacguggagcuggaccuccagcgcagcguccaggccgugcugcgggagcuguccacccaggcccccgcgcuccagagcaaccagggcauguggcgcuggucccugcacaagaagguggagcgggacccggggaagucccccguccuggugcgcauccuccugcgggagcuggagaaggccgagucccaggaccuccgccacgugaucaucccccugcugcacaccgucauguacgugcucacgaaggccaccggcaucaccgaggagcuguaccagcggaucuacgccuucugcacccgccugcucacgcugcccaccccguacugcaccguggcccuggacugcgcgauccggcucaagaccgagauggccguccccgggacgcuguaccagcgcauggugaucgccgagcagaaccugaccaacgagcucuaccccuaccaggagcggguguuccuguucgucgaccccgagcuggugagcgccuccgugugcagcgcgcuccugcuggagaucgaggccgcccaggcccagcagaccccggagaccugcaugcgccacgucgugucccacgcccuccaggcggcccugggcgaggccugccacgccggggcccugcaccggaagcuccaggcgagcccccgccggacgcuggagcacuacuuccacgccguggucgccgcccuggagcagauggccuccgaggcgagccccucccgcgagggccacguggagcggcucgaggagaucuacugcagccugcugggccccgccgccgggcgcugcggcggggaccucgugcaggagcggccgcccuccaucccccugcccagcccguacaucaccuuccaccuguggaccggcgaggagcagcucuggaaggagcugguccuguuccuccgcccccggucccagcugcgccugagcgccgaccucgaggugcuggaccugcaggggcuccgccccgaccgggagcuggcccgcgugagcguccuguccaccgacagcggcaucgagcgggaccugcccacgggcgcggacgagcucccggcccccgggucccccgagauggagcgcgccggccugcagcggaagggcgggaucaagaagcgcgccuggccccuggacuuccucaugccgggcagcugggacgggccgcccggccugcaccggcgcaccgggcggcccuccggcgacggggagaugcugcccggcgugagccgccuccacaccgcgcggguccuggugcugggcgacgaccgcaugcucgggcggcuggcccaggccuaccaccgccugcggaagcgcgagacccagaaguucugccucacgccccggcugucccugcagcucuacuacauccccgugcuggccccggagaagcccgccgcgagccgccagcccgagcugggcgagcucgccaccuuccuggggcgggucgaccccugguaccaguccaacgugaacacccugugcccggccauccacaagcucgccgagaugccgcccagccuggacaccucccgcacgguggaccccuucauccuggacgucaucaccuacuacauccgcaugggcacccagcccaucuacuuccagaucuacaccgugaagaucuucuucagcgaccucucccaggaccccacggaggacaucuuccugaucgagcugaaggugaagauccaggacagcaaguuccccaaggacggguucagcccccggcgccggggcgucgccgagggcccgggggcggagcucagccugugcuaccagaaggcccugcucucccaccgcccccgggaggugaccgugagccugcgcgccaccggccugauccucaaggccauccccgccuccgacaccgaggucagcgggagcucccacugcccccugccggcggcccccgugacggaccacacgugccugaacgugaacgucaccgagguggucaagagcuccaaccucgccggcaagagcuucuccaccgugaccaacaccuuccggaccaacaacauccagauccagagccgcgaccagcggcugcugacccucucccuggacaaggacgaccagcgcaccuuccgggacguggugcgcuucgaggucgcccccugccccgagccgugcagcggggcgcagaaguccaaggcccccuggcugaaccuccacggccagcaggagguggaggccaucaaggccaagcccaagccccugcugaugccgaucaacacguucagcggcaucgugcaguga

SEQ ID NO: 9231 - RNA, 2265 nt, Artificial Sequence
  derived and/or modified sequence opt2 from PI3K__Homo_sapiens__AAV30085
auggaguccuccgacgucgagcucgaccuccagcgcuccguccaggccguccuccgcgagcucuccacccaggcccccgcccuccaguccaaccagggcauguggcgcuggucccuccacaagaaggucgagcgcgaccccggcaagucccccguccucguccgcauccuccuccgcgagcucgagaaggccgagucccaggaccuccgccacgucaucaucccccuccuccacaccgucauguacguccucaccaaggccaccggcaucaccgaggagcucuaccagcgcaucuacgccuucugcacccgccuccucacccuccccacccccuacugcaccgucgcccucgacugcgccauccgccucaagaccgagauggccguccccggcacccucuaccagcgcauggucaucgccgagcagaaccucaccaacgagcucuaccccuaccaggagcgcgucuuccucuucgucgaccccgagcucgucuccgccuccgucugcuccgcccuccuccucgagaucgaggccgcccaggcccagcagacccccgagaccugcaugcgccacgucgucucccacgcccuccaggccgcccucggcgaggccugccacgccggcgcccuccaccgcaagcuccaggccuccccccgccgcacccucgagcacuacuuccacgccgucgucgccgcccucgagcagauggccuccgaggccucccccucccgcgagggccacgucgagcgccucgaggagaucuacugcucccuccucggccccgccgccggccgcugcggcggcgaccucguccaggagcgcccccccuccaucccccuccccucccccuacaucaccuuccaccucuggaccggcgaggagcagcucuggaaggagcucguccucuuccuccgcccccgcucccagcuccgccucuccgccgaccucgagguccucgaccuccagggccuccgccccgaccgcgagcucgcccgcgucuccguccucuccaccgacuccggcaucgagcgcgaccuccccaccggcgccgacgagcuccccgcccccggcucccccgagauggagcgcgccggccuccagcgcaagggcggcaucaagaagcgcgccuggccccucgacuuccucaugcccggcuccugggacggcccccccggccuccaccgccgcaccggccgccccuccggcgacggcgagaugcuccccggcgucucccgccuccacaccgcccgcguccucguccucggcgacgaccgcaugcucggccgccucgcccaggccuaccaccgccuccgcaagcgcgagacccagaaguucugccucaccccccgccucucccuccagcucuacuacauccccguccucgcccccgagaagcccgccgccucccgccagcccgagcucggcgagcucgccaccuuccucggccgcgucgaccccugguaccaguccaacgucaacacccucugccccgccauccacaagcucgccgagaugccccccucccucgacaccucccgcaccgucgaccccuucauccucgacgucaucaccuacuacauccgcaugggcacccagcccaucuacuuccagaucuacaccgucaagaucuucuucuccgaccucucccaggaccccaccgaggacaucuuccucaucgagcucaaggucaagauccaggacuccaaguuccccaaggacggcuucuccccccgccgccgcggcgucgccgagggccccggcgccgagcucucccucugcuaccagaaggcccuccucucccaccgcccccgcgaggucaccgucucccuccgcgccaccggccucauccucaaggccauccccgccuccgacaccgaggucuccggcuccucccacugcccccuccccgccgcccccgucaccgaccacaccugccucaacgucaacgucaccgaggucgucaaguccuccaaccucgccggcaaguccuucuccaccgucaccaacaccuuccgcaccaacaacauccagauccagucccgcgaccagcgccuccucacccucucccucgacaaggacgaccagcgcaccuuccgcgacgucguccgcuucgaggucgcccccugccccgagcccugcuccggcgcccagaaguccaaggcccccuggcucaaccuccacggccagcaggaggucgaggccaucaaggccaagcccaagccccuccucaugcccaucaacaccuucuccggcaucguccaguga

SEQ ID NO: 9232 - RNA, 2265 nt, Artificial Sequence
  derived and/or modified sequence opt3 from PI3K__Homo_sapiens__AAV30085
auggagagcuccgacguggaacuggaucuccagagaucuguccaagccguucuuagggagcugucaacccaggcucccgcauugcagaguaaccagggcauguggcgguggagcuuacacaagaaaguggaacgcgacccugggaaguccccaguacuggugcgaauccuacuccgugagcuggaaaaagccgagucucaagaucuuagacaugucauuauaccgcuguugcacacagugauguacguucucacuaaggcgacgggaaucaccgaggaacuguaucagaggauuuacgcuuucugcacacggcugcucacuuuacccaccccuuauuguacaguggcccuggacugcgcaauccgccuuaaaaccgagauggccgucccagguacuuuguaccagagaauggugauugcugaacagaaucugacaaacgagcuauaucccuaccaagagaggguauuucucuucguugauccugaacuggugucggcaucagucuguagcgcccuucuguuggagaucgaagcugcccaggcgcagcagaccccagagacgugcaugcggcauguggugagucacgcacuccaagccgcucugggcgaagccugucaugcaggggcuuuacaccgcaagcugcaggccucuccccgaagaacucucgagcacuauuuucaugcggucguugccgcacuugagcagauggcuuccgaagccagcccuuccagggagggacacguggaacggcuggaggaaauauacugcucauugcuaggcccagcugccggucguugugggggagaccugguacaagagcgcccgcccaguaucccucucccaagccccuacauuaccuuccaucuguggacaggcgaggaacagcuuuggaaggagcugguguuguuucucagaccuaggucucagcugcgguuauccgcagaucuggaaguccuagaccuccagggccugcgaccagaucgcgagcuugccagagugucaguuuugagcacugacagugggaucgaaagggaucugcccaccggagcugacgagcucccggcgccugguucucccgagauggaacgggcaggccugcaacgcaaagggggaauuaagaaaagagccuggccacuugauuuccugaugccuggcuccugggacggucccccaggguugcacaggcguacaggacggcccagcggcgacggcgagaugcucccuggggugucgcgacugcacaccgcuagagucuuagugcugggagaugacaggaugcuaggucgccucgcccaggcauaucaucggcugagaaagagggaaacgcagaaauuuugccuuacuccacgcuugucucugcagcucuacuauaucccgguacuggcccccgagaagccugcugccucccgacaaccagaguuaggcgaacuggcaacauuccuugggcggguugaucccugguaccagucaaaugugaacaccuuguguccugcgauacacaagcucgcugagaugccacccagucuggacacuagccguacagucgauccguuuauucuagacgugaucaccuauuacauuagaaugggaacgcagccuaucuauuuccagaucuacaccgucaaaauauuuuucuccgaucugucucaagacccaacagaagauauuuuucucaucgagcugaaggugaaaauucaggacagcaaguuccccaaagauggcuucucaccuaggcgccgggguguugccgaagggcccggcgcagagcuuaguuugugcuaccagaaggcccuguuaucccauagaccaagggaggugacuguaagccuccgagcuaccggacugauccuuaaagccauaccugcaucugacacagaagucucaggcaguagccacuguccccugccagcugccccggugacugaccauaccugcuugaauguuaacgugacagaggucgugaaguccucuaaucucgcggggaagucguuuagcaccguaacuaacacguuccgcacaaauaacauucagauccaaucccgggaucagagacugcuaacccugucacucgacaaagaugaccagaggacuuuucgugaugugguucgcuucgaagucgccccuugccccgagccauguaguggagcucaaaagucuaaagcacccuggcugaaucuucacggucagcaggaaguggaggccaucaaggcuaaaccuaagccauugcugaugcccauuaacaccuuuagcggcaucgugcaguga

SEQ ID NO: 9233 - RNA, 2265 nt, Artificial Sequence
  derived and/or modified sequence opt4 from PI3K__Homo_sapiens__AAV30085
auggagagcagcgacguggagcuggaccugcagagaagcgugcaggccgugcugagagagcugagcacccaggcccccgcccugcagagcaaccagggcauguggagauggagccugcacaagaagguggagagagaccccggcaagagccccgugcuggugagaauccugcugagagagcuggagaaggccgagagccaggaccugagacacgugaucaucccccugcugcacaccgugauguacgugcugaccaaggccaccggcaucaccgaggagcuguaccagagaaucuacgccuucugcaccagacugcugacccugcccacccccuacugcaccguggcccuggacugcgccaucagacugaagaccgagauggccgugcccggcacccuguaccagagaauggugaucgccgagcagaaccugaccaacgagcuguaccccuaccaggagagaguguuccuguucguggaccccgagcuggugagcgccagcgugugcagcgcccugcugcuggagaucgaggccgcccaggcccagcagacccccgagaccugcaugagacacguggugagccacgcccugcaggccgcccugggcgaggccugccacgccggcgcccugcacagaaagcugcaggccagccccagaagaacccuggagcacuacuuccacgccgugguggccgcccuggagcagauggccagcgaggccagccccagcagagagggccacguggagagacuggaggagaucuacugcagccugcugggccccgccgccggcagaugcggcggcgaccuggugcaggagagaccccccagcaucccccugcccagccccuacaucaccuuccaccuguggaccggcgaggagcagcuguggaaggagcuggugcuguuccugagacccagaagccagcugagacugagcgccgaccuggaggugcuggaccugcagggccugagacccgacagagagcuggccagagugagcgugcugagcaccgacagcggcaucgagagagaccugcccaccggcgccgacgagcugcccgcccccggcagccccgagauggagagagccggccugcagagaaagggcggcaucaagaagagagccuggccccuggacuuccugaugcccggcagcugggacggcccccccggccugcacagaagaaccggcagacccagcggcgacggcgagaugcugcccggcgugagcagacugcacaccgccagagugcuggugcugggcgacgacagaaugcugggcagacuggcccaggccuaccacagacugagaaagagagagacccagaaguucugccugacccccagacugagccugcagcuguacuacauccccgugcuggcccccgagaagcccgccgccagcagacagcccgagcugggcgagcuggccaccuuccugggcagaguggaccccugguaccagagcaacgugaacacccugugccccgccauccacaagcuggccgagaugccccccagccuggacaccagcagaaccguggaccccuucauccuggacgugaucaccuacuacaucagaaugggcacccagcccaucuacuuccagaucuacaccgugaagaucuucuucagcgaccugagccaggaccccaccgaggacaucuuccugaucgagcugaaggugaagauccaggacagcaaguuccccaaggacggcuucagccccagaagaagaggcguggccgagggccccggcgccgagcugagccugugcuaccagaaggcccugcugagccacagacccagagaggugaccgugagccugagagccaccggccugauccugaaggccauccccgccagcgacaccgaggugagcggcagcagccacugcccccugcccgccgcccccgugaccgaccacaccugccugaacgugaacgugaccgagguggugaagagcagcaaccuggccggcaagagcuucagcaccgugaccaacaccuucagaaccaacaacauccagauccagagcagagaccagagacugcugacccugagccuggacaaggacgaccagagaaccuucagagacguggugagauucgagguggcccccugccccgagcccugcagcggcgcccagaagagcaaggcccccuggcugaaccugcacggccagcaggagguggaggccaucaaggccaagcccaagccccugcugaugcccaucaacaccuucagcggcaucgugcaguga

SEQ ID NO: 9234 - RNA, 2265 nt, Artificial Sequence
  derived and/or modified sequence opt5 from PI3K__Homo_sapiens__AAV30085
auggagagcuccgacguggaacuggaucuccagagaucuguccaagccguucugcgggagcuuagcacccaggcucccgcccugcaguccaaccagggcauguggcgcuggucucuccacaagaaaguggaaagagacccuggaaagagcccggugcugguccggauccuucugcgcgagcucgaaaaagcggagucccaagaucugagacaugugauuaucccccugcuccacacaguuauguacgugcugacgaaggcuaccgggauuacagaggaacuuuaucagcggaucuacgccuucugcacccgccugcucacacugccuacccccuauuguacagucgcccuugacugcgcuauuagacugaaaaccgagauggccgugccuggcacgcucuaccagcggaugguuaucgcugaacagaaucugaccaacgagcuguaucccuaccaagagcgcguguuucucuucgucgauccugaacuggugucugccagcguguguuccgcgcuucugcucgagaucgaagccgcucaggcccagcagacaccggagaccugcaugagacaugucguuagccacgcucugcaagccgcgcuuggggaagccugucaugcuggagcccugcaccggaagcuccaggcuucuccccgcagaacacuggagcacuauuuucaugccgugguggccgcucuggagcagauggcguccgaagccagcccuucucgggagggccacgucgaacgccucgaggaaauuuacugcucccugcuugggcccgcugccggaagauguggcggcgaccuggugcaagagcggccucccagcaucccgcucccuucucccuacauuaccuuccaucuguggacgggggaggaacagcuuuggaaggagcugguucucuuucugagaccucgcucccagcugcggcucagcgccgaucuggaagugcuugaccugcagggacucagacccgaucgcgagcuggcucgggucuccgugcugucuacagacagcggcaucgaaagagaucuucccaccggggccgacgagcucccugcgccgggaucccccgagauggaacgcgcuggccugcaacggaaagggggaauuaagaaaagagccuggccucuggauuuccucaugcccggcagcugggacggcccucccgggcugcaccgccggacaggaagaccgucuggcgacggggagaugcuuccuggaguuucccgccugcacaccgcccgggugcucguccugggcgaugacagaaugcuggggcggcuugcucaggccuaucaucgccucagaaagcgggaaacccagaaauuuugccugacacccagacugagccuccagcuguacuauaucccugugcuugcucccgagaagccugccgcgucucgccaacccgagcugggagaacucgccacguuccugggccgggucgauccgugguaccagagcaaugugaacacccuguguccugcuauucacaaacuugccgagaugccucccucccucgacacaucuagaaccguugaucccuuuauccuggacgugaucacauauuacauucgcaugggcacccagccgaucuauuuccagauuuacacggucaagaucuuuuucagcgaucugucccaagaccccacagaagauauuuuucucaucgagcugaaggugaaaauccaggacagcaaguucccuaaagauggguucucucccagacggcgcggaguugcugaaggcccuggggccgagcuuucccugugcuaccagaaggcgcuccugagccauagaccccgggaggugaccgucucucugcgcgccaccggacuuauucucaaagcuaucccugccuccgacacagaagugagcggcuccucucacuguccccugccggcugccccugugaccgaccauacaugccugaauguuaacgucacggagguggucaagagcuccaaucucgccgggaagucuuuuagcaccgugacaaacaccuucagaacaaauaacauucagauccaaucccgggaucagcgccugcuuacccugagccucgacaaagaugaccagagaacguuucgggaugugguucgcuucgaaguggcucccugcccugagcccuguucuggcgcgcaaaaguccaaagccccguggcugaaucugcacggacagcaggaagucgaggcuauuaaggccaaaccuaagccccuucugaugccuaucaacaccuuuagcggcaucgugcaguga

SEQ ID NO: 9235 - protein, 887 aa, Artificial Sequence
  PI3K__Homo_sapiens__Q8NEB9
MGEAEKFHYIYSCDLDINVQLKIGSLEGKREQKSYKAVLEDPMLKFSGLYQETCSDLYVTCQVFAEGKPLALPVRTSYKAFSTRWNWNEWLKLPVKYPDLPRNAQVALTIWDVYGPGKAVPVGGTTVSLFGKYGMFRQGMHDLKVWPNVEADGSEPTKTPGRTSSTLSEDQMSRLAKLTKAHRQGHMVKVDWLDRLTFREIEMINESEKRSSNFMYLMVEFRCVKCDDKEYGIVYYEKDGDESSPILTSFELVKVPDPQMSMENLVESKHHKLARSLRSGPSDHDLKPNAATRDQLNIIVSYPPTKQLTYEEQDLVWKFRYYLTNQEKALTKFLKCVNWDLPQEAKQALELLGKWKPMDVEDSLELLSSHYTNPTVRRYAVARLRQADDEDLLMYLLQLVQALKYENFDDIKNGLEPTKKDSQSSVSENVSNSGINSAEIDSSQIITSPLPSVSSPPPASKTKEVPDGENLEQDLCTFLISRACKNSTLANYLYWYVIVECEDQDTQQRDPKTHEMYLNVMRRFSQALLKGDKSVRVMRSLLAAQQTFVDRLVHLMKAVQRESGNRKKKNERLQALLGDNEKMNLSDVELIPLPLEPQVKIRGIIPETATLFKSALMPAQLFFKTEDGGKYPVIFKHGDDLRQDQLILQIISLMDKLLRKENLDLKLTPYKVLATSTKHGFMQFIQSVPVAEVLDTEGSIQNFFRKYAPSENGPNGISAEVMDTYVKSCAGYCVITYILGVGDRHLDNLLLTKTGKLFHIDFGYILGRDPKPLPPPMKLNKEMVEGMGGTQSEQYQEFRKQCYTAFLHLRRYSNLILNLFSLMVDANIPDIALEPDKTVKKVQDKFRLDLSDEEAVHYMQSLIDESVHALFAAVVEQIHKFAQYWRK

SEQ ID NO: 9236 - RNA, 2664 nt, Artificial Sequence
  PI3K__Homo_sapiens__AAH33004
augggggaagcagagaaguuucacuacaucuauaguugugaccuggauaucaacguccagcuuaagauaggaagcuuggaagggaagagagaacaaaagaguuauaaagcuguccuggaagacccaauguugaaguucucaggacuauaucaagagacaugcucugaucuuuauguuacuugucaaguuuuugcagaagggaagccuuuggccuugccagugagaacauccuacaaagcauuuaguacaagauggaacuggaaugaauggcugaaacuaccaguaaaauacccugaccugcccaggaaugcccaaguggcccucaccauaugggauguguauggucccggaaaagcagugccuguaggaggaacaacgguuucgcucuuuggaaaauacggcauguuucgccaagggaugcaugacuugaaagucuggccuaauguagaagcagauggaucagaacccacaaaaacuccuggcagaacaaguagcacucucucagaagaucagaugagccgucuugccaagcucaccaaagcucaucgacaaggacacauggugaaaguagauuggcuggauagauugacauuuagagaaauagaaaugauaaaugagagugaaaaacgaaguucuaauuucauguaccugaugguugaauuucgaugugucaagugugaugauaaggaauaugguauuguuuauuaugaaaaggacggugaugaaucaucuccaauuuuaacaaguuuugaauuagugaaaguuccugacccccagaugucuauggagaauuuaguugagagcaaacaccacaagcuugcccggaguuuaagaaguggaccuucugaccacgaucugaaacccaaugcugccacgagagaucaguuaaauauuauugugaguuauccaccaaccaagcaacuuacauaugaagaacaagaucuuguuuggaaguuuagauauuaucuuacgaaucaagaaaaagccuugacaaaauucuugaaauguguuaauugggaucuaccucaagaggccaaacaggccuuggaacuucugggaaaauggaagccgauggauguagaggacuccuuggagcuguuauccucucauuacaccaacccaacugugaggcguuaugcuguugcccgguugcgacaggccgaugaugaggauuuguugauguaccuauuacaauugguccaggcucucaaauaugaaaauuuugaugauauaaagaauggauuggaaccuaccaagaaggauagucagaguucagugucagaaaaugugucaaauucuggaauaaauucugcagaaauagauagcucccaaauuauaaccagcccccuuccuucagucucuucaccuccuccugcaucaaaaacaaaagaaguuccagauggcgaaaaucuggaacaagaucucuguaccuucuugauaucgagagccugcaaaaacucaacacuggcuaauuauuuauacugguaugugauaguggaaugugaagaucaagauacucagcagagagauccaaagacccaugagauguacuugaacguaaugagaagauucagccaagcauuguugaagggugauaagucugucagaguuaugcguucuuugcuggcugcacaacagacauuuguagaucgguuggugcaucuaaugaaggcaguacaacgcgaaaguggaaaucguaagaaaaagaaugagagacuacaggcauugcuuggagauaaugaaaagaugaauuugucagauguggaacuuaucccguugccuuuagaaccccaagugaaaauuagaggaauaauuccggaaacagcuacacuguuuaaaagugcccuuaugccugcacaguuguuuuuuaagacggaagauggaggcaaauauccaguuauauuuaagcauggagaugauuuacgucaagaucaacuuauucuucaaaucauuucacucauggacaagcuguuacggaaagaaaaucuggacuugaaauugacaccuuauaagguguuagccaccaguacaaaacauggcuucaugcaguuuauccagucaguuccuguggcugaaguucuugauacagagggaagcauucagaacuuuuuuagaaaauaugcaccaagugagaaugggccaaaugggauuagugcugaggucauggacacuuacguuaaaagcugugcuggauauugcgugaucaccuauauacuuggaguuggagacaggcaccuggauaaccuuuugcuaacaaaaacaggcaaacucuuccacauagacuuuggauauauuuugggucgggauccaaagccucuuccuccaccaaugaagcugaauaaagaaaugguagaaggaauggggggcacacagagugagcaguaccaagaguuccguaaacaguguuacacggcuuuccuccaccugcgaagguauucuaaucugauuuugaacuuguuuuccuugaugguugaugcaaacauuccagauauugcacuugaaccagauaaaacugugaaaaagguucaggauaaauuccgcuuagaccugucggaugaagaggcugugcauuacaugcagagucugauugaugagaguguccaugcucuuuuugcugcagugguggaacagauucacaaguuugcccaguacuggagaaaauga

SEQ ID NO: 9237 - RNA, 2664 nt, Artificial Sequence
  derived and/or modified sequence opt1 from PI3K__Homo_sapiens__AAH33004
augggcgaggccgagaaguuccacuacaucuacagcugcgaccuggacaucaacgugcagcucaagaucgggucccuggagggcaagcgcgagcagaaguccuacaaggccguccuggaggaccccaugcucaaguucuccgggcuguaccaggagaccugcagcgaccuguacgugaccugccagguguucgcggagggcaagccccucgcccugcccguccggacguccuacaaggccuucagcacccgcuggaacuggaacgaguggcugaagcuccccgugaaguaccccgaccugccgcggaacgcccagguggcccugaccaucugggacgucuacgggcccggcaaggcggugcccgugggcgggaccacggucucccucuucggcaaguacgggauguuccgccagggcaugcacgaccugaagguguggcccaacguggaggccgacgggagcgagccgaccaagacccccggccggaccuccagcacgcuguccgaggaccagaugagccgccucgccaagcugaccaaggcccaccggcagggccacauggucaagguggacuggcuggaccgccucaccuuccgggagaucgagaugaucaacgaguccgagaagcgcagcuccaacuucauguaccugaugguggaguuccggugcgucaagugcgacgacaaggaguacgggaucguguacuacgagaaggacggcgacgagagcucccccauccugaccagcuucgagcucgugaagguccccgacccgcagauguccauggagaaccugguggagagcaagcaccacaagcuggcgcgcagccuccgguccgggcccagcgaccacgaccugaagcccaacgccgccacgcgcgaccagcugaacaucaucguguccuacccgcccaccaagcagcucaccuacgaggagcaggaccuggucuggaaguuccgguacuaccugaccaaccaggagaaggcccucacgaaguuccugaagugcgugaacugggaccugccccaggaggccaagcaggcgcucgagcugcugggcaaguggaagcccauggacguggaggacagccucgagcugcuguccagccacuacaccaaccccaccguccgccgguacgccguggcccgccuccggcaggccgacgacgaggaccugcugauguaccuccugcagcugguccaggcccucaaguacgagaacuucgacgacaucaagaacggccuggagccgaccaagaaggacucccagagcuccgugagcgagaacguguccaacagcgggaucaacuccgcggagaucgacagcucccagaucaucacgagcccccugcccuccgucagcagcccgccgcccgccagcaagaccaaggaggugcccgacggcgagaaccucgagcaggaccugugcaccuuccugaucagccgcgccugcaagaacuccacccuggccaacuaccucuacugguacgugaucgucgagugcgaggaccaggacacgcagcagcgggaccccaagacccacgagauguaccugaacgugaugcgccgcuucagccaggcccugcucaagggggacaaguccgugcgggucaugcgcagccugcuggcggcccagcagaccuucguggaccggcucgugcaccugaugaaggccguccagcgcgaguccggcaaccggaagaagaagaacgagcgccugcaggcccuccugggggacaacgagaagaugaaccugagcgacguggagcucaucccccugccccuggagccccaggugaagauccggggcaucaucccggagaccgccacccucuucaaguccgcgcugaugcccgcccagcuguucuucaagacggaggacggcgggaaguaccccgucaucuucaagcacggcgacgaccuccgccaggaccagcugauccugcagaucaucagccucauggacaagcugcugcggaaggagaaccucgaccugaagcugacccccuacaaggugcucgccaccuccacgaagcacggguucaugcaguucauccagagcgugccggucgccgaggugcuggacaccgagggcuccauccagaacuucuuccgcaaguacgcgcccagcgagaacgggcccaacggcaucuccgccgaggugauggacaccuacgucaagagcugcgccggcuacugcgugaucaccuacauccugggggugggcgaccggcaccucgacaaccugcugcucacgaagaccgggaagcuguuccacaucgacuucggcuacauccuggggcgcgaccccaagccgcucccgccgcccaugaagcugaacaaggagauggucgagggcaugggcgggacccaguccgagcaguaccaggaguuccggaagcagugcuacaccgccuuccugcaccuccgccgguacagcaaccugauccugaaccucuucucccugaugguggacgccaacauccccgacaucgcgcuggagcccgacaagaccgugaagaagguccaggacaaguuccgccucgaccugagcgacgaggaggccgugcacuacaugcagagccugaucgacgaguccgugcacgcccucuucgccgccgucguggagcagauccacaaguucgcgcaguacuggcggaaguga

SEQ ID NO: 9238 - RNA, 2664 nt, Artificial Sequence
  derived and/or modified sequence opt2 from PI3K__Homo_sapiens__AAH33004
augggcgaggccgagaaguuccacuacaucuacuccugcgaccucgacaucaacguccagcucaagaucggcucccucgagggcaagcgcgagcagaaguccuacaaggccguccucgaggaccccaugcucaaguucuccggccucuaccaggagaccugcuccgaccucuacgucaccugccaggucuucgccgagggcaagccccucgcccuccccguccgcaccuccuacaaggccuucuccacccgcuggaacuggaacgaguggcucaagcuccccgucaaguaccccgaccucccccgcaacgcccaggucgcccucaccaucugggacgucuacggccccggcaaggccguccccgucggcggcaccaccgucucccucuucggcaaguacggcauguuccgccagggcaugcacgaccucaaggucuggcccaacgucgaggccgacggcuccgagcccaccaagacccccggccgcaccuccuccacccucuccgaggaccagaugucccgccucgccaagcucaccaaggcccaccgccagggccacauggucaaggucgacuggcucgaccgccucaccuuccgcgagaucgagaugaucaacgaguccgagaagcgcuccuccaacuucauguaccucauggucgaguuccgcugcgucaagugcgacgacaaggaguacggcaucgucuacuacgagaaggacggcgacgaguccucccccauccucaccuccuucgagcucgucaagguccccgacccccagauguccauggagaaccucgucgaguccaagcaccacaagcucgcccgcucccuccgcuccggccccuccgaccacgaccucaagcccaacgccgccacccgcgaccagcucaacaucaucgucuccuacccccccaccaagcagcucaccuacgaggagcaggaccucgucuggaaguuccgcuacuaccucaccaaccaggagaaggcccucaccaaguuccucaagugcgucaacugggaccucccccaggaggccaagcaggcccucgagcuccucggcaaguggaagcccauggacgucgaggacucccucgagcuccucuccucccacuacaccaaccccaccguccgccgcuacgccgucgcccgccuccgccaggccgacgacgaggaccuccucauguaccuccuccagcucguccaggcccucaaguacgagaacuucgacgacaucaagaacggccucgagcccaccaagaaggacucccaguccuccgucuccgagaacgucuccaacuccggcaucaacuccgccgagaucgacuccucccagaucaucaccuccccccuccccuccgucuccucccccccccccgccuccaagaccaaggagguccccgacggcgagaaccucgagcaggaccucugcaccuuccucaucucccgcgccugcaagaacuccacccucgccaacuaccucuacugguacgucaucgucgagugcgaggaccaggacacccagcagcgcgaccccaagacccacgagauguaccucaacgucaugcgccgcuucucccaggcccuccucaagggcgacaaguccguccgcgucaugcgcucccuccucgccgcccagcagaccuucgucgaccgccucguccaccucaugaaggccguccagcgcgaguccggcaaccgcaagaagaagaacgagcgccuccaggcccuccucggcgacaacgagaagaugaaccucuccgacgucgagcucaucccccucccccucgagccccaggucaagauccgcggcaucauccccgagaccgccacccucuucaaguccgcccucaugcccgcccagcucuucuucaagaccgaggacggcggcaaguaccccgucaucuucaagcacggcgacgaccuccgccaggaccagcucauccuccagaucaucucccucauggacaagcuccuccgcaaggagaaccucgaccucaagcucacccccuacaagguccucgccaccuccaccaagcacggcuucaugcaguucauccaguccguccccgucgccgagguccucgacaccgagggcuccauccagaacuucuuccgcaaguacgcccccuccgagaacggccccaacggcaucuccgccgaggucauggacaccuacgucaaguccugcgccggcuacugcgucaucaccuacauccucggcgucggcgaccgccaccucgacaaccuccuccucaccaagaccggcaagcucuuccacaucgacuucggcuacauccucggccgcgaccccaagccccuccccccccccaugaagcucaacaaggagauggucgagggcaugggcggcacccaguccgagcaguaccaggaguuccgcaagcagugcuacaccgccuuccuccaccuccgccgcuacuccaaccucauccucaaccucuucucccucauggucgacgccaacauccccgacaucgcccucgagcccgacaagaccgucaagaagguccaggacaaguuccgccucgaccucuccgacgaggaggccguccacuacaugcagucccucaucgacgaguccguccacgcccucuucgccgccgucgucgagcagauccacaaguucgcccaguacuggcgcaaguga

SEQ ID NO: 9239 - RNA, 2664 nt, Artificial Sequence
  derived and/or modified sequence opt3 from PI3K__Homo_sapiens__AAH33004
augggcgaggccgaaaaguuccacuacaucuauagcugcgaccuggauauuaacgugcagcucaaaauagggucccuugagggaaagagagaacaaaaaucuuacaaggcuguccuggaggaccccauguugaaauuuucagguuuauaucaggaaaccuguagugaucuguacguuacaugccagguguucgcagagggcaagccucuagcccucccaguaaggacuagcuauaaggcguuuuccacgcgguggaauuggaacgaguggcugaaacuuccggugaaguaccccgaccugccucgcaaugcucaggucgccuugaccaucugggauguguaugggccaggaaaagcaguucccgugggcgguacaacugucucucucuucgggaaguacggaauguuucgacaaggcaugcaugaccugaaaguguggccuaacguagaagccgauggcucggagccaaccaagacacccgggcguaccucaagcacucugagugaagaccagauguccagacucgcuaaguuaacaaaagcacacaggcagggacauaugguuaagguggauuggcuggaccggcuuaccuuccgcgagauugagaugaucaaugaaucugagaaaagaagcuccaacuuuauguacuugauggucgaguucaggugugugaagugcgaugacaaagaguaugguauuguguacuaugaaaaggauggcgacgagucaaguccuauccugacgagcuuugagcuagucaaaguuccagacccgcagaugucuauggaaaaucucguggaguccaagcaccauaagcuggcccggucacuucgcagcgggcccagugaucacgaccugaaaccuaacgcugccacucgagaucaauugaauauaaucguaucuuacccacccaccaagcagcucacauaugaagaacaggaccugguguggaaauucagauacuauuuaacuaaccaggaaaaggcgcugaccaaauuucucaagugugucaauugggaucuuccucaagaggcaaagcaggcccuggaguugcuaggaaaauggaagccaauggacguggaagauucccuggagcuccugagcucgcacuacacaaaccccaccguuaggcgguacgcuguggcccgucuucgccaggcagacgaugaagaccuguugauguaucuccugcaauuaguccaggcucugaaauacgagaauuucgaugacauuaagaacggccuagaaccgacgaaaaaggacucucaguccucagugagugagaauguaagcaacuccgguaucaacucugccgagauugauagcucacagaucauaacaaguccucuccccuccguuagcucuccaccucccgcgucaaagacuaaagaagugccagacggggagaaucuggaacaagaucuuugcaccuuuuugauuaguagagccuguaagaacagcacucuggcaaauuaucucuacugguaugucaucguggagugcgaggaccaggauacacagcagagggaccccaaaacccaugaaauguaccugaacgucaugcggcgauucucccaagcucugcugaagggagauaaaucugugcgcguuaugagaucguugcucgccgcucagcagacguucguggacaggcugguacacuuaaugaaggccguccagcgggagagcggcaaucgcaagaaaaagaacgaaagacugcaagcacuacucggcgauaaugagaaaaugaaccuguccgacguggaacuuauuccuuugccacuggagccgcagguuaagaucagggggaucauucccgagaccgccacacucuuuaaaucagcucugaugccugcgcaguuauucuuuaagacugaagauggagguaaauauccagugauauucaagcauggcgacgaucugcgucaggaccaacuuaucuugcagauuaucagucucauggacaagcugcuacggaaagagaaucuggaucucaagcugacccccuacaaaguccuugcaacaucuacuaagcacggguuuaugcaguucauacaaagcgugccuguagccgaaguguuggacaccgagggauccauucagaacuuuuuccgaaaauacgcuccaucagaaaauggccccaacgguaucagcgccgagguuauggauacauaugucaagucuugugcaggguacugcgugaucaccuauauucugggcgugggagacagacacuuagauaaucuccugcuuacuaagacgggcaaacuguuucauaucgacuucggguacauuuugggaagggauccgaagccucucccacccccuaugaaacugaacaaggagauggucgaagguaugggcgggacacaguccgagcaguaucaagaauuucgcaaacaguguuacaccgccuuccuacaccuucggagauauaguaaucucauacugaaccuuuuuagcuugaugguugacgcuaacauccccgauauugcccuggagccagacaagacugugaagaaagugcaggauaaguucagguuagaccucucugaugaagaggcaguacauuacaugcagucccugaucgacgagucaguccacgcgcuuuucgcugccgugguugaacaaauccauaaauuugcacaguacuggcgcaaguga

SEQ ID NO: 9240 - RNA, 2664 nt, Artificial Sequence
  derived and/or modified sequence opt4 from PI3K__Homo_sapiens__AAH33004
augggcgaggccgagaaguuccacuacaucuacagcugcgaccuggacaucaacgugcagcugaagaucggcagccuggagggcaagagagagcagaagagcuacaaggccgugcuggaggaccccaugcugaaguucagcggccuguaccaggagaccugcagcgaccuguacgugaccugccagguguucgccgagggcaagccccuggcccugcccgugagaaccagcuacaaggccuucagcaccagauggaacuggaacgaguggcugaagcugcccgugaaguaccccgaccugcccagaaacgcccagguggcccugaccaucugggacguguacggccccggcaaggccgugcccgugggcggcaccaccgugagccuguucggcaaguacggcauguucagacagggcaugcacgaccugaagguguggcccaacguggaggccgacggcagcgagcccaccaagacccccggcagaaccagcagcacccugagcgaggaccagaugagcagacuggccaagcugaccaaggcccacagacagggccacauggugaagguggacuggcuggacagacugaccuucagagagaucgagaugaucaacgagagcgagaagagaagcagcaacuucauguaccugaugguggaguucagaugcgugaagugcgacgacaaggaguacggcaucguguacuacgagaaggacggcgacgagagcagccccauccugaccagcuucgagcuggugaaggugcccgacccccagaugagcauggagaaccugguggagagcaagcaccacaagcuggccagaagccugagaagcggccccagcgaccacgaccugaagcccaacgccgccaccagagaccagcugaacaucaucgugagcuacccccccaccaagcagcugaccuacgaggagcaggaccugguguggaaguucagauacuaccugaccaaccaggagaaggcccugaccaaguuccugaagugcgugaacugggaccugccccaggaggccaagcaggcccuggagcugcugggcaaguggaagcccauggacguggaggacagccuggagcugcugagcagccacuacaccaaccccaccgugagaagauacgccguggccagacugagacaggccgacgacgaggaccugcugauguaccugcugcagcuggugcaggcccugaaguacgagaacuucgacgacaucaagaacggccuggagcccaccaagaaggacagccagagcagcgugagcgagaacgugagcaacagcggcaucaacagcgccgagaucgacagcagccagaucaucaccagcccccugcccagcgugagcagccccccccccgccagcaagaccaaggaggugcccgacggcgagaaccuggagcaggaccugugcaccuuccugaucagcagagccugcaagaacagcacccuggccaacuaccuguacugguacgugaucguggagugcgaggaccaggacacccagcagagagaccccaagacccacgagauguaccugaacgugaugagaagauucagccaggcccugcugaagggcgacaagagcgugagagugaugagaagccugcuggccgcccagcagaccuucguggacagacuggugcaccugaugaaggccgugcagagagagagcggcaacagaaagaagaagaacgagagacugcaggcccugcugggcgacaacgagaagaugaaccugagcgacguggagcugaucccccugccccuggagccccaggugaagaucagaggcaucauccccgagaccgccacccuguucaagagcgcccugaugcccgcccagcuguucuucaagaccgaggacggcggcaaguaccccgugaucuucaagcacggcgacgaccugagacaggaccagcugauccugcagaucaucagccugauggacaagcugcugagaaaggagaaccuggaccugaagcugacccccuacaaggugcuggccaccagcaccaagcacggcuucaugcaguucauccagagcgugcccguggccgaggugcuggacaccgagggcagcauccagaacuucuucagaaaguacgcccccagcgagaacggccccaacggcaucagcgccgaggugauggacaccuacgugaagagcugcgccggcuacugcgugaucaccuacauccugggcgugggcgacagacaccuggacaaccugcugcugaccaagaccggcaagcuguuccacaucgacuucggcuacauccugggcagagaccccaagccccugcccccccccaugaagcugaacaaggagaugguggagggcaugggcggcacccagagcgagcaguaccaggaguucagaaagcagugcuacaccgccuuccugcaccugagaagauacagcaaccugauccugaaccuguucagccugaugguggacgccaacauccccgacaucgcccuggagcccgacaagaccgugaagaaggugcaggacaaguucagacuggaccugagcgacgaggaggccgugcacuacaugcagagccugaucgacgagagcgugcacgcccuguucgccgccgugguggagcagauccacaaguucgcccaguacuggagaaaguga

SEQ ID NO: 9241 - RNA, 2664 nt, Artificial Sequence
  derived and/or modified sequence opt5 from PI3K__Homo_sapiens__AAH33004
augggcgaggccgaaaaguuccacuacaucuauagcugcgaccuggauauuaacgugcagcucaaaaucgggucccuggagggaaagagagaacaaaaaucuuacaaggcuguccuugaggaccccaugcugaaauuuagcggccucuaucaggaaaccuguuccgaucuguacguuacaugccagguguucgccgaggggaagccucuugcgcugccggugcggacgucuuauaaggcuuuuagcacccgcuggaauuggaacgaguggcucaaacugcccgucaaguacccugaccugcccagaaaugcccagguggcccucacaauuugggauguuuauggaccuggcaaagcugugcccgucgggggaaccacagugucccuguucggcaaguacggcauguuucggcaagggaugcaugaccuuaaaguuuggccuaacguggaagccgauggaucugagccgaccaagacacccggccgcaccagcuccacgcugagcgaagaccagaugucuagacucgcuaagcugaccaaagcccaccggcaggggcauauggucaagguggauuggcuugaccgccugacauucagagagaucgagaugauuaaugaauccgagaaacggagcucuaacuuuauguaccucaugguggaguuccgcugugucaagugcgaugacaaagaguauggaaucguuuacuaugaaaaggauggcgacgaguccagcccuauccugaccucuuuugagcuggugaaagugcccgacccucagauguccauggaaaaucucgucgagagcaagcaccauaagcuggcgagaucccuucggucugggcccagcgaucacgaccugaaaccgaacgccgcuacacgcgaucaacucaauauuaucguguccuacccucccaccaagcagcugacguaugaagaacaggaccuuguuuggaaauucagauacuaucugacaaaccaggaaaaggcccucaccaaauuucugaagugugugaauugggaucugccucaagaggcuaagcaggcccucgagcugcuuggaaaauggaagcccauggacgucgaagauagccuggagcuccugucuucccacuacacaaaccccaccgugcggcgcuacgcgguugccagacuucggcaggcugacgaugaagaccugcucauguaucugcugcaacucgugcaggcccugaaauacgagaauuucgaugacauuaagaacggccuugaaccuaccaaaaaggacagccagucuagcgucuccgagaaugugucuaacagcggcaucaacuccgcugagauugauagcucucagaucauuacauccccgcugcccagcgucucuuccccucccccugccagcaagacgaaagaagugcccgacggggagaaucucgaacaagaucugugcaccuuucugaucuccagagccuguaagaacucuacacuugcuaauuaucucuacugguauguuaucguggagugcgaggaccaggauacccagcagcgcgacccgaaaacacaugaaauguaccugaacgucaugcggagauucagccaagcgcugcucaagggagauaaauccgugcgcguuaugcggucucugcuugccgcucagcagaccuucguggacagacugguccaccucaugaaggccgugcagcgcgagagcggcaaucggaagaaaaagaacgaaagacugcaagcccugcuuggggauaaugagaaaaugaaccucuccgacguggaacugauuccucugccccucgagccucagguuaagauccgcggaauuauccccgagacggcuacacuguuuaaaagcgcccuuaugccugcgcagcuguucuuuaagaccgaagauggcgggaaauaucccgucauuuucaagcauggagacgaucuccggcaggaccaacugauccugcagaucauuucucuuauggacaagcuccugagaaaagagaaucuggaucucaagcugaccccguacaaagugcuugcuacauccaccaagcacggcuuuaugcaguucauccaaagcgugccugucgccgaagugcuggacacagagggcucuauucagaacuuuuuccgcaaauacgcccccuccgaaaaugggcccaacggaaucagcgcugagguuauggauacguaugugaagucuugugccggcuacugcgucauuaccuauauccucggggugggagaccggcaccuggauaaucugcuucucacaaagaccggcaaacuguuucauaucgacuucggguacauucugggcagagauccuaagccgcugcccccucccaugaaacugaacaaggagaugguugaaggaaugggcgggacacagagcgagcaguaucaagaauuucggaaacaguguuacaccgcuuuccuucaccuccgcagauauuccaaucucauccugaaccuguuuagccuuaugguggacgccaacauuccugauaucgcgcuggagcccgacaagacggucaagaaagugcaggauaaguuccggcucgaccugucugaugaagaggccguucauuacaugcagucccucauugacgagagcgugcacgcucuguucgccgcugucguggaacaaauccauaaauuugcccaguacuggagaaaguga

SEQ ID NO: 9242 - protein, 880 aa, Artificial Sequence
  PI3K__Homo_sapiens__Q8WYR1
MQPGATTCTEDRIQHALERCLHGLSLSRRSTSWSAGLCLNCWSLQELVSRDPGHFLILLEQILQKTREVQEKGTYDLLTPLALLFYSTVLCTPHFPPDSDLLLKAASTYHRFLTWPVPYCSICQELLTFIDAELKAPGISYQRLVRAEQGLPIRSHRSSTVTVLLLNPVEVQAEFLAVANKLSTPGHSPHSAYTTLLLHAFQATFGAHCDVPGLHCRLQAKTLAELEDIFTETAEAQELASGIGDAAEARRWLRTKLQAVGEKAGFPGVLDTAKPGKLHTIPIPVARCYTYSWSQDSFDILQEILLKEQELLQPGILGDDEEEEEEEEEVEEDLETDGHCAERDSLLSTSSLASHDSTLSLASSQASGPALSRHLLTSFVSGLSDGMDSGYVEDSEESSSEWPWRRGSQERRGHRRPGQKFIRIYKLFKSTSQLVLRRDSRSLEGSSDTALPLRRAGSLCSPLDEPVSPPSRAQRSRSLPQPKLGTQLPSWLLAPASRPQRRRPFLSGDEDPKASTLRVVVFGSDRISGKVARAYSNLRRLENNRPLLTRFFKLQFFYVPVKRSHGTSPGACPPPRSQTPSPPTDSPRHASPGELGTTPWEESTNDISHYLGMLDPWYERNVLGLMHLPPEVLCQQSLKAEAQALEGSPTQLPILADMLLYYCRFAARPVLLQVYQTELTFITGEKTTEIFIHSLELGHSAATRAIKASGPGSKRLGIDGDREAVPLTLQIIYSKGAISGRSRWSNLEKVCTSVNLNKACRKQEELDSSMEALTLNLTEVVKRQNSKSKKGFNQISTSQIKVDKVQIIGSNSCPFAVCLDQDERKILQSVVRCEVSPCYKPEKSDLSSPPQTPPDLPAQAAPDLCSLLCLPIMTFSGALP

SEQ ID NO: 9243 - RNA, 2643 nt, Artificial Sequence
  PI3K__Homo_sapiens__ABY87553
augcagccaggggccacgacaugcacggaggaccgcauccagcaugcccuggaacgcugccugcauggacucagccucagccgccgcuccaccuccuggucagcugggcugugucugaacugcuggagccugcaggagcuggucagcagggacccgggccacuuccuuauccuccuugagcagauccugcagaagacccgagagguccaggagaagggcaccuacgaccugcucaccccgcuggcccugcucuucuauuccacuguucuuuguacaccacacuucccaccagacucggaucuccuucugaaggcagccagcaccuaccaccgguuccugaccuggccuguuccuuacugcagcaucugccaggagcugcucaccuucauugaugcugaacucaaggccccagggaucuccuaccagagacuggugagggcugagcagggccugcccaucaggagucaccgcagcuccaccgucaccgugcugcugcugaacccaguggaagugcaggccgaguuccuugcuguagccaauaagcugaguacgcccggacacucgccucacagugccuacaccacccugcuccugcacgccuuccaggccaccuuuggggcccacugugacgucccgggccugcacugcaggcuacaggccaagacccuggcagagcuugaggacaucuucacggagaccgcagaggcacaggagcuggcaucuggcaucggggaugcugcagaggcccggcgguggcucaggaccaagcugcaggcggugggagaaaaagcuggcuucccugggguguuagacacugcaaaaccagggaagcuccauaccauccccaucccugucgccaggugcuacaccuacagcuggagccaggacagcuuugacauccugcaggaaauccugcucaaggaacaggagcuacuccagccagggauccugggagaugaugaagaggaggaagaggaggaggaggagguggaggaggacuuggaaacugacgggcacugugccgagagagauucccugcucuccaccagcucuuuggcgucccaugacuccacccugucccuugcauccucccaggccucggggccggcccucucgcgccaucugcugacuuccuuugucucaggccucucugauggcauggacagcggcuacguggaggacagcgaggagagcuccuccgaguggccuuggaggcguggcagccaggaacgccgaggccaccgcaggccugggcagaaguucaucaggaucuauaaacucuucaagagcaccagccagcugguacugcggagggacucucggagccuggagggcagcucggacacggcccugccccugaggcgggcagggagccucugcagcccccuggacgaaccaguaucacccccuucccgggcccagcgcucccgcucccugccccagcccaaacucgguacccagcugcccagcuggcuucuggccccugcuucacgcccccagcgccgccgccccuuccugaguggagaugaggaucccaaggcuuccacgcuacguguuguggucuuuggcuccgaucggauuucagggaagguggcucgggcguacagcaaccuucggcggcuggagaacaaucgcccacuccucacacgguucuucaaacuucaguucuucuacgugccugugaagcgaagucaugggaccagcccuggugccuguccacccccucggagccagacgcccucacccccgacagacuccccuaggcacgccagcccuggagagcugggcaccaccccaugggaggagagcaccaaugacaucucccacuaccucggcaugcuggaccccugguaugagcgcaauguacugggccucaugcaccugcccccugaaguccugugccagcagucccugaaggcugaagcccaggcccuggagggcuccccaacccagcugcccauccuggcugacaugcuacucuacuacugccgcuuugccgccagaccggugcugcugcaagucuaucagaccgagcugaccuucaucacuggggagaagacgacagagaucuucauccacuccuuggagcugggucacuccgcugccacacgugccaucaaggcgucagguccuggcagcaagcggcugggcaucgauggcgaccgggaggcuguuccucuaacacuacagauuauuuacagcaagggggccaucaguggacgaagucgcuggagcaaccuggagaaggucuguaccuccgugaaccucaacaaggccugccggaagcaggaggagcuggauuccagcauggaggcccugacgcuaaaccugacagaaguggugaaaaggcagaacuccaaauccaagaagggcuuuaaccagauuagcacaucgcagaucaaaguggacaaggugcagaucaucggcuccaacagcugccccuuugcugugugccuggaccaggaugagagaaagauccugcagaguguagucagaugugaggucucaccgugcuacaagccagagaagagcgaccucuccucaccaccccagacgccuccugaccugccggcccaggccgcaccugaucucugcucccuucucugccugcccaucaugacuuucaguggagcucugcccuag

SEQ ID NO: 9244 - RNA, 2643 nt, Artificial Sequence
  derived and/or modified sequence opt1 from PI3K__Homo_sapiens__ABY87553
augcagcccggcgccacgaccugcacggaggaccgcauccagcacgcccuggagcggugccuccacgggcugagccugucccgccggagcaccuccuggagcgcgggccucugccugaacugcuggucccugcaggagcucgugagccgcgacccggggcacuuccugauccugcucgagcagauccugcagaagacccgggagguccaggagaagggcaccuacgaccugcucacgccccuggcccuccucuucuacuccaccgugcugugcacgccccacuucccgcccgacagcgaccugcuccugaaggccgccuccaccuaccaccgcuuccugaccuggcccgugcccuacugcagcaucugccaggagcuccugaccuucaucgacgccgagcugaaggcgcccgggaucuccuaccagcggcucguccgcgccgagcagggccugccgauccggagccaccgcuccagcaccgugaccgugcugcuccugaaccccgucgaggugcaggccgaguuccuggccguggcgaacaagcucuccacgcccggccacagcccccacuccgccuacaccacccugcugcuccacgccuuccaggccaccuucggggcccacugcgacgucccgggccugcacugccggcugcaggcgaagacgcucgccgagcuggaggacaucuucaccgagaccgccgaggcccaggagcuggccagcgggaucggcgacgcggccgaggcccgccgguggcuccgcaccaagcugcaggccgugggggagaaggccggcuuccccggcgugcuggacacggcgaagcccgggaagcuccacaccauccccaucccggucgcccggugcuacaccuacuccuggagccaggacagcuucgacauccugcaggagauccugcugaaggagcaggagcugcugcagcccggcauccucggggacgacgaggaggaggaggaggaggaggaggagguggaggaggaccuggagaccgacggccacugcgccgagcgcgacucccugcugagcaccuccagccucgccucccacgacagcacccugucccuggccagcucccaggcgagcggccccgcccucucccggcaccuccugaccagcuucguguccgggcugagcgacggcauggacuccggguacgucgaggacagcgaggaguccagcuccgaguggcccuggcgccggggcagccaggagcgccgggggcaccgccgcccgggccagaaguucauccggaucuacaagcuguucaagagcaccucccagcuggugcuccgccgggacagccgcucccuggagggcagcuccgacacggcccugccccuccggcgcgccgggagccugugcagcccccuggacgagcccguguccccgcccucccgggcgcagcgcagccggucccucccccagcccaagcugggcacccagcugccgagcuggcuccuggcccccgccucccgcccccagcggcgccggccguuccugagcggggacgaggaccccaaggccuccacccuccgcgucgugguguucggcagcgaccggaucuccgggaaggucgcccgcgcguacagcaaccugcggcgccuggagaacaaccggccccuccugacccgcuucuucaagcugcaguucuucuacgugcccgugaagcgcagccacggcacguccccgggcgccugcccgccgccccggagccagacccccuccccgcccaccgacagcccccgccacgccucccccggggagcucggcaccacgcccugggaggagagcaccaacgacaucucccacuaccuggggaugcuggaccccugguacgagcggaacguccucggccugaugcaccucccgcccgaggugcugugccagcagagccugaaggccgaggcccaggcgcuggaggggucccccacccagcuccccauccuggccgacaugcugcucuacuacugccgcuucgccgcccggcccguccugcuccagguguaccagaccgagcugaccuucaucacgggcgagaagaccaccgagaucuucauccacagccuggagcugggccacuccgccgcgacccgcgccaucaaggccagcgggcccggcuccaagcggcucgggaucgacggcgaccgcgaggccgugccccugacgcugcagaucaucuacagcaagggcgcgaucuccgggcggagccgcugguccaaccucgagaaggucugcaccagcgugaaccugaacaaggccugccggaagcaggaggagcuggacuccagcauggaggcccucacccugaaccugaccgagguggucaagcgccagaacagcaaguccaagaagggcuucaaccagaucagcacgucccagaucaagguggacaaggugcagaucaucgggagcaacuccugccccuucgccgucugccucgaccaggacgagcggaagauccugcagagcguggugcgcugcgaggucucccccugcuacaagccggagaaguccgaccugagcagcccgccccagaccccgcccgaccuccccgcccaggcggcccccgaccugugcucccugcucugccugcccaucaugaccuucagcggcgcccugcccuga

SEQ ID NO: 9245 - RNA, 2643 nt, Artificial Sequence
  derived and/or modified sequence opt2 from PI3K__Homo_sapiens__ABY87553
augcagcccggcgccaccaccugcaccgaggaccgcauccagcacgcccucgagcgcugccuccacggccucucccucucccgccgcuccaccuccugguccgccggccucugccucaacugcuggucccuccaggagcucgucucccgcgaccccggccacuuccucauccuccucgagcagauccuccagaagacccgcgagguccaggagaagggcaccuacgaccuccucaccccccucgcccuccucuucuacuccaccguccucugcaccccccacuucccccccgacuccgaccuccuccucaaggccgccuccaccuaccaccgcuuccucaccuggcccguccccuacugcuccaucugccaggagcuccucaccuucaucgacgccgagcucaaggcccccggcaucuccuaccagcgccucguccgcgccgagcagggccuccccauccgcucccaccgcuccuccaccgucaccguccuccuccucaaccccgucgagguccaggccgaguuccucgccgucgccaacaagcucuccacccccggccacuccccccacuccgccuacaccacccuccuccuccacgccuuccaggccaccuucggcgcccacugcgacguccccggccuccacugccgccuccaggccaagacccucgccgagcucgaggacaucuucaccgagaccgccgaggcccaggagcucgccuccggcaucggcgacgccgccgaggcccgccgcuggcuccgcaccaagcuccaggccgucggcgagaaggccggcuuccccggcguccucgacaccgccaagcccggcaagcuccacaccauccccauccccgucgcccgcugcuacaccuacuccuggucccaggacuccuucgacauccuccaggagauccuccucaaggagcaggagcuccuccagcccggcauccucggcgacgacgaggaggaggaggaggaggaggaggaggucgaggaggaccucgagaccgacggccacugcgccgagcgcgacucccuccucuccaccuccucccucgccucccacgacuccacccucucccucgccuccucccaggccuccggccccgcccucucccgccaccuccucaccuccuucgucuccggccucuccgacggcauggacuccggcuacgucgaggacuccgaggaguccuccuccgaguggcccuggcgccgcggcucccaggagcgccgcggccaccgccgccccggccagaaguucauccgcaucuacaagcucuucaaguccaccucccagcucguccuccgccgcgacucccgcucccucgagggcuccuccgacaccgcccucccccuccgccgcgccggcucccucugcuccccccucgacgagcccgucuccccccccucccgcgcccagcgcucccgcucccucccccagcccaagcucggcacccagcuccccuccuggcuccucgcccccgccucccgcccccagcgccgccgccccuuccucuccggcgacgaggaccccaaggccuccacccuccgcgucgucgucuucggcuccgaccgcaucuccggcaaggucgcccgcgccuacuccaaccuccgccgccucgagaacaaccgcccccuccucacccgcuucuucaagcuccaguucuucuacguccccgucaagcgcucccacggcaccucccccggcgccugcccccccccccgcucccagacccccuccccccccaccgacuccccccgccacgccucccccggcgagcucggcaccacccccugggaggaguccaccaacgacaucucccacuaccucggcaugcucgaccccugguacgagcgcaacguccucggccucaugcaccucccccccgagguccucugccagcagucccucaaggccgaggcccaggcccucgagggcucccccacccagcuccccauccucgccgacaugcuccucuacuacugccgcuucgccgcccgccccguccuccuccaggucuaccagaccgagcucaccuucaucaccggcgagaagaccaccgagaucuucauccacucccucgagcucggccacuccgccgccacccgcgccaucaaggccuccggccccggcuccaagcgccucggcaucgacggcgaccgcgaggccgucccccucacccuccagaucaucuacuccaagggcgccaucuccggccgcucccgcugguccaaccucgagaaggucugcaccuccgucaaccucaacaaggccugccgcaagcaggaggagcucgacuccuccauggaggcccucacccucaaccucaccgaggucgucaagcgccagaacuccaaguccaagaagggcuucaaccagaucuccaccucccagaucaaggucgacaagguccagaucaucggcuccaacuccugccccuucgccgucugccucgaccaggacgagcgcaagauccuccaguccgucguccgcugcgaggucucccccugcuacaagcccgagaaguccgaccucuccucccccccccagaccccccccgaccuccccgcccaggccgcccccgaccucugcucccuccucugccuccccaucaugaccuucuccggcgcccuccccuga

SEQ ID NO: 9246 - RNA, 2643 nt, Artificial Sequence
  derived and/or modified sequence opt3 from PI3K__Homo_sapiens__ABY87553
augcagcccggcgccaccacaugcacugaggacagaauccaacacgcucuggaaaggugucuccaugggcuuagccugucccggcgcucuacgucauggagugcaggauugugcuuaaacuguuggagccugcaggagcuagugucccgagauccuggucacuuccucauucugcuugaacagauacugcagaagacccgugagguccaagaaaaaggcacauacgacuugcucacuccacuggcccugcucuuuuauucuaccguuuuaugcacaccgcauuuucccccugauucggaccugcuuuugaaggcggcuucaaccuaccacagauuucugacuuggccagugcccuauuguagcaucugccaggagcuacucacauucauugaugccgagcugaaagcaccugggaucaguuaccagaggcuuguacgggccgaacagggacugccaauucgcucccauagaucuagcaccgugacggucuugcuccugaaucccguggagguucaagcugaauuuuuagcaguggccaacaagcuguccacuccuggccacucaccacacagugcuuauaccacacuccuucugcaugccuuccaggcgacuuuuggugcacacugugacgucccgggguugcauugcaggcuacaggccaaaacccuggcugagcucgaggauaucuucacagaaaccgccgaggcacaggaacuggcuagcggaauaggcgacgccgcggaggcccggcgcuggcuucgaacgaagcugcaagcagugggcgaaaaggcuggguuucccggaguauuggauacugccaaaccugguaagcuccacacaaucccaauucccguugcuagauguuacaccuauucuuggucccaggacucauucgauauccugcaggagauuuuacugaaagagcaagaacuacuccagccuggcauccugggggacgaugaggaagaggaagaggaggaagaggaaguggaggaagaccuugagacugacggacacugcgccgagagggauagcuugcugaguacaucuucccucgcaagccaugacucgacccugucucuugccuccucacaggcuaguggcccagcgcugagccggcacuugcucacguccuuugucucuggucugagcgaugggauggacucaggauacguggaagauagugaggaauccagcucugaguggcccuggcgucgcggcucacaggagagaaggggccaucggcgaccggggcaaaaguucauacgcauuuacaaauuauuuaagaguaccagccagcuggugcuaagaagggacucccggucucucgaaggaucgagcgauacagcacugccucuucgcagagccgguuccuuguguucaccccuggacgagccagucaguccucccucuagggcucagcguagccggucccucccacagcccaagcugggcacucaauuaccuucauggcugcuugccccagcaagccgaccgcagagaaggcgccccuucuugucuggggaugaagacccuaaagccuccacccuccggguugugguauucggaagugauagaaucagcggcaagguggcuagggccuauucuaaucugcgccgacuagagaacaaucggccacugcucacacguuucuucaaacugcaguuuuucuacguccccgugaagagaucccacgguacuucaccuggggcaugcccacccccgaggagucagaccccuagcccacccacagacucgccucgccaugcgucccccggcgaacuuggaaccacuccaugggaggagucuacgaacgacauuagccacuauuugggcaugcuggauccuugguacgaacggaauguuuuagggcucaugcaucugcccccagaggugcuuugccaacagucacugaaagcugaagcccaggcauuggagggaaguccgacacagcucccuauccuggccgacaugcuacuguauuacuguagauuugcugccaggcccguccuccugcaaguguaucagaccgaacuuacuuucaucaccggugagaagacaaccgagauuuuuauacacuccuuggaacugggccacucugcagcuacucgagccaucaaagcgagcgggccaggauccaagcgcuuaggcauugauggugaccgggaggccguaccccucacacugcagaucauauacucaaagggggcuauuagcggcagaaguagguggucuaaccuugaaaaaguuugcacguccgugaaucugaacaaggcaugucguaaacaagaggaacuagauagcucgauggaggcccucacccugaauuugacugaggucgugaagcgccagaacucaaaaucuaagaagggauucaaucagaucaguacaucccagaucaaagucgacaaggugcaaauuaucggcagcaacucuugcccuuuugcuguuugucuggaucaggacgaacggaaaauuuuacagagcgugguaagaugcgaggucuccccauguuacaagcccgaaaaaucagaucucaguagcccuccgcagaccccacccgaccugccugcccaagcagcgccagaucuuugcucucuguugugucuccccauaaugacauucuccggggcccugccuuga

SEQ ID NO: 9247 - RNA, 2643 nt, Artificial Sequence
  derived and/or modified sequence opt4 from PI3K__Homo_sapiens__ABY87553
augcagcccggcgccaccaccugcaccgaggacagaauccagcacgcccuggagagaugccugcacggccugagccugagcagaagaagcaccagcuggagcgccggccugugccugaacugcuggagccugcaggagcuggugagcagagaccccggccacuuccugauccugcuggagcagauccugcagaagaccagagaggugcaggagaagggcaccuacgaccugcugaccccccuggcccugcuguucuacagcaccgugcugugcaccccccacuucccccccgacagcgaccugcugcugaaggccgccagcaccuaccacagauuccugaccuggcccgugcccuacugcagcaucugccaggagcugcugaccuucaucgacgccgagcugaaggcccccggcaucagcuaccagagacuggugagagccgagcagggccugcccaucagaagccacagaagcagcaccgugaccgugcugcugcugaaccccguggaggugcaggccgaguuccuggccguggccaacaagcugagcacccccggccacagcccccacagcgccuacaccacccugcugcugcacgccuuccaggccaccuucggcgcccacugcgacgugcccggccugcacugcagacugcaggccaagacccuggccgagcuggaggacaucuucaccgagaccgccgaggcccaggagcuggccagcggcaucggcgacgccgccgaggccagaagauggcugagaaccaagcugcaggccgugggcgagaaggccggcuuccccggcgugcuggacaccgccaagcccggcaagcugcacaccauccccauccccguggccagaugcuacaccuacagcuggagccaggacagcuucgacauccugcaggagauccugcugaaggagcaggagcugcugcagcccggcauccugggcgacgacgaggaggaggaggaggaggaggaggagguggaggaggaccuggagaccgacggccacugcgccgagagagacagccugcugagcaccagcagccuggccagccacgacagcacccugagccuggccagcagccaggccagcggccccgcccugagcagacaccugcugaccagcuucgugagcggccugagcgacggcauggacagcggcuacguggaggacagcgaggagagcagcagcgaguggcccuggagaagaggcagccaggagagaagaggccacagaagacccggccagaaguucaucagaaucuacaagcuguucaagagcaccagccagcuggugcugagaagagacagcagaagccuggagggcagcagcgacaccgcccugccccugagaagagccggcagccugugcagcccccuggacgagcccgugagcccccccagcagagcccagagaagcagaagccugccccagcccaagcugggcacccagcugcccagcuggcugcuggcccccgccagcagaccccagagaagaagacccuuccugagcggcgacgaggaccccaaggccagcacccugagaguggugguguucggcagcgacagaaucagcggcaagguggccagagccuacagcaaccugagaagacuggagaacaacagaccccugcugaccagauucuucaagcugcaguucuucuacgugcccgugaagagaagccacggcaccagccccggcgccugccccccccccagaagccagacccccagcccccccaccgacagccccagacacgccagccccggcgagcugggcaccacccccugggaggagagcaccaacgacaucagccacuaccugggcaugcuggaccccugguacgagagaaacgugcugggccugaugcaccugccccccgaggugcugugccagcagagccugaaggccgaggcccaggcccuggagggcagccccacccagcugcccauccuggccgacaugcugcuguacuacugcagauucgccgccagacccgugcugcugcagguguaccagaccgagcugaccuucaucaccggcgagaagaccaccgagaucuucauccacagccuggagcugggccacagcgccgccaccagagccaucaaggccagcggccccggcagcaagagacugggcaucgacggcgacagagaggccgugccccugacccugcagaucaucuacagcaagggcgccaucagcggcagaagcagauggagcaaccuggagaaggugugcaccagcgugaaccugaacaaggccugcagaaagcaggaggagcuggacagcagcauggaggcccugacccugaaccugaccgagguggugaagagacagaacagcaagagcaagaagggcuucaaccagaucagcaccagccagaucaagguggacaaggugcagaucaucggcagcaacagcugccccuucgccgugugccuggaccaggacgagagaaagauccugcagagcguggugagaugcgaggugagccccugcuacaagcccgagaagagcgaccugagcagccccccccagaccccccccgaccugcccgcccaggccgcccccgaccugugcagccugcugugccugcccaucaugaccuucagcggcgcccugcccuga

SEQ ID NO: 9248 - RNA, 2643 nt, Artificial Sequence
  derived and/or modified sequence opt5 from PI3K__Homo_sapiens__ABY87553
augcagcccggcgccaccacaugcacggaggacagaauccaacacgcucuggaacggugucuccaugggcugagccuuucccgcagaucuaccagcugguccgccggacugugccucaacuguuggucucugcaggagcuugugagccgggauccuggccacuuccugauucuccuggaacagauccugcagaagacacgcgagguccaagaaaaagggaccuacgaccuccugacaccgcuugcgcugcucuuuuauuccaccguucugugcacaccccauuucccucccgauucugaccuucugcucaaggcugccagcaccuaccacagauuucugacguggccugugcccuauuguuccauuugccaggagcugcucaccuucaucgaugccgagcugaaagcuccuggaauuagcuaccagcggcuugugcgcgccgaacagggccugccgaucagaucucaucgguccagcacagucaccgugcuccugcuuaaucccguugaggugcaagcugaauuucuggccgucgcgaacaagcucucuacaccugggcacagcccccacagcgccuauaccacgcugcugcuccaugcuuuccaggccacauuuggagcucacugugacgugccuggccugcauugccgccuucaggccaaaacccuggcggagcucgaggauaucuucacagaaaccgccgaggcucaggaacuggccucuggcauuggggacgcugccgaggccagacgguggcuucgcaccaagcugcaagcuguuggagaaaaggcgggcuuucccggggugcucgauacagccaaaccgggaaagcugcacacgaucccuauucccgucgcuagauguuacaccuauuccuggagccaggacuccuucgauauccugcaggagauucuccugaaagagcaagaacuucugcagccuggcauccucggggacgaugaggaagaggaagaggaggaagaggaaguggaggaagaccuggagacagacggacacugcgccgagcgggauucucugcuuagcaccuccagccucgccucucaugacuccacacugagccuggcuucuagccaggccuccggccccgcgcucucucgccaucugcuuaccagcuuuguguccggccugagcgaugggauggacucuggauacgucgaagauuccgaggaauccucuuccgaguggcccuggagacggggcagccaggagagacgcgggcaccggagaccuggacaaaaguucauucgcaucuacaaacucuuuaaguccacgucucagcugguucugcggagagacagccgcucccuugaaggcucuagcgauacagcucucccgcugcggagagccgggucccuguguagcccccucgacgagccugugucucccccuucccgcgcccagcggagcagaucucugccccagccgaaacuuggaacccaacugccuuccuggcuccuggcucccgccagccgcccucagcggagacggcccuuccugucuggcgaugaagacccuaaggcuagcacccuucgcguggucguguucggcuccgauagaaucagcgggaagguugcccgggcguauucuaaucucagacgccuggagaacaaucggccccugcucacaagauuuuucaaacugcaguuuuucuacgugccggucaagcgcucccacggaaccagcccuggcgccugcccuccgcccagaucccagacacccucucccccuacggacagcccccggcaugcuuccccuggggaacuuggaaccacacccugggaggagucuaccaacgacauuagccacuaucugggcaugcucgauccuugguacgaacgcaaugugcuggggcugaugcaccuucccccggagguucucugccaacagucccugaaagccgaagcucaggcccuggagggcucuccuacacagcuccccauccuggcggacaugcuucuguauuacuguagauuugccgcucggccugugcuccugcaagucuaucagaccgaacugacguucauuaccggagagaagacaaccgagaucuuuauucauagccuugaacugggccacuccgccgcuacacgcgccaucaaagccagcgggcccggaucuaagagacucggcaucgauggggaccgggaggcugugccgcugacccuccagauuaucuacuccaagggagcgauuagcggccgcucuagaugguccaaccuggaaaaagucugcacgagcgugaaucuuaacaaggccugucggaaacaagaggaacuggauucuuccauggaggcucucacacugaaucugaccgagguugugaagcgccagaacagcaaauccaagaagggguucaaucagaucagcacaucucagauuaaagucgacaaggugcaaaucaucggcagcaacuccugcccuuuugccguuugucuugaucaggacgaaagaaaaauucugcagucugugguccggugcgaggugagccccuguuacaagccugaaaaauccgaucucucuagcccuccccagaccccgcccgaccugcccgcccaagcugccccugaucucugcucccugcuuugucugcccaucaugaccuucucuggagcgcucccuuga

SEQ ID NO: 9249 - protein, 968 aa, Artificial Sequence
  PKD2__Homo_sapiens__Q13563
MVNSSRVQPQQPGDAKRPPAPRAPDPGRLMAGCAAVGASLAAPGGLCEQRGLEIEMQRIRQAAARDPPAGAAASPSPPLSSCSRQAWSRDNPGFEAEEEEEEVEGEEGGMVVEMDVEWRPGSRRSAASSAVSSVGARSRGLGGYHGAGHPSGRRRRREDQGPPCPSPVGGGDPLHRHLPLEGQPPRVAWAERLVRGLRGLWGTRLMEESSTNREKYLKSVLRELVTYLLFLIVLCILTYGMMSSNVYYYTRMMSQLFLDTPVSKTEKTNFKTLSSMEDFWKFTEGSLLDGLYWKMQPSNQTEADNRSFIFYENLLLGVPRIRQLRVRNGSCSIPQDLRDEIKECYDVYSVSSEDRAPFGPRNGTAWIYTSEKDLNGSSHWGIIATYSGAGYYLDLSRTREETAAQVASLKKNVWLDRGTRATFIDFSVYNANINLFCVVRLLVEFPATGGVIPSWQFQPLKLIRYVTTFDFFLAACEIIFCFFIFYYVVEEILEIRIHKLHYFRSFWNCLDVVIVVLSVVAIGINIYRTSNVEVLLQFLEDQNTFPNFEHLAYWQIQFNNIAAVTVFFVWIKLFKFINFNRTMSQLSTTMSRCAKDLFGFAIMFFIIFLAYAQLAYLVFGTQVDDFSTFQECIFTQFRIILGDINFAEIEEANRVLGPIYFTTFVFFMFFILLNMFLAIINDTYSEVKSDLAQQKAEMELSDLIRKGYHKALVKLKLKKNTVDDISESLRQGGGKLNFDELRQDLKGKGHTDAEIEAIFTKYDQDGDQELTEHEHQQMRDDLEKEREDLDLDHSSLPRPMSSRSFPRSLDDSEEDDDEDSGHSSRRRGSISSGVSYEEFQVLVRRVDRMEHSIGSIVSKIDAVIVKLEIMERAKLKRREVLGRLLDGVAEDERLGRDSEIHREQMERLVREELERWESDDAASQISHGLGTPVGLNGQPRPRSSRPSSSQSTEGMEGAGGNGSSNVHV

SEQ ID NO: 9250 - RNA, 2907 nt, Artificial Sequence
  PKD2__Homo_sapiens__AAC50520
auggugaacuccagucgcgugcagccucagcagcccggggacgccaagcggccgcccgcgccccgcgcgccggacccgggccggcugauggcuggcugcgcggccgugggcgccagccucgccgccccgggcggccucugcgagcagcggggccuggagaucgagaugcagcgcauccggcaggcggccgcgcgggaccccccggccggagccgcggccuccccuucuccuccgcucucgucgugcucccggcaggcguggagccgcgauaaccccggcuucgaggccgaggaggaggaggaggagguggaaggggaagaaggcggaauggugguggagauggacguagaguggcgcccgggcagccggaggucggccgccuccucggccgugagcuccgugggcgcgcggagccgggggcuugggggcuaccacggcgcgggccacccgagcgggaggcggcgccggcgagaggaccagggcccgccgugccccagcccagucggcggcggggacccgcugcaucgccaccucccccuggaagggcagccgccccgaguggccugggcggagaggcugguucgcgggcugcgaggucucuggggaacaagacucauggaggaaagcagcacuaaccgagagaaauaccuuaaaaguguuuuacgggaacuggucacauaccuccuuuuucucauagucuugugcaucuugaccuacggcaugaugagcuccaauguguacuacuacacccggaugaugucacagcucuuccuagacacccccguguccaaaacggagaaaacuaacuuuaaaacucugucuuccauggaagacuucuggaaguucacagaaggcuccuuauuggaugggcuguacuggaagaugcagcccagcaaccagacugaagcugacaaccgaaguuucaucuucuaugagaaccugcuguuagggguuccacgaauacggcaacuccgagucagaaauggauccugcucuaucccccaggacuugagagaugaaauuaaagagugcuaugaugucuacucugucaguagugaagauagggcucccuuugggccccgaaauggaaccgcuuggaucuacacaagugaaaaagacuugaaugguaguagccacuggggaaucauugcaacuuauaguggagcuggcuauuaucuggauuugucaagaacaagagaggaaacagcugcacaaguugcuagccucaagaaaaaugucuggcuggaccgaggaaccagggcaacuuuuauugacuucucaguguacaacgccaacauuaaccuguucuguguggucagguuauugguugaauucccagcaacagguggugugauuccaucuuggcaauuucagccuuuaaagcugauccgauaugucacaacuuuugauuucuuccuggcagccugugagauuaucuuuuguuucuuuaucuuuuacuaugugguggaagagauauuggaaauucgcauucacaaacuacacuauuucaggaguuucuggaauugucuggauguugugaucguugugcugucagugguagcuauaggaauuaacauauacagaacaucaaauguggaggugcuacuacaguuucuggaagaucaaaauacuuuccccaacuuugagcaucuggcauauuggcagauacaguucaacaauauagcugcugucacaguauuuuuugucuggauuaagcucuucaaauucaucaauuuuaacaggaccaugagccagcucucgacaaccaugucucgaugugccaaagaccuguuuggcuuugcuauuauguucuucauuauuuuccuagcguaugcucaguuggcauaccuugucuuuggcacucaggucgaugacuucaguacuuuccaagaguguaucuucacucaauuccguaucauuuugggcgauaucaacuuugcagagauugaggaagcuaaucgaguuuugggaccaauuuauuucacuacauuuguguucuuuauguucuucauucuuuugaauauguuuuuggcuaucaucaaugauacuuacucugaagugaaaucugacuuggcacagcagaaagcugaaauggaacucucagaucuuaucagaaagggcuaccauaaagcuuuggucaaacuaaaacugaaaaaaaauaccguggaugacauuucagagagucugcggcaaggaggaggcaaguuaaacuuugacgaacuucgacaagaucucaaagggaagggccauacugaugcagagauugaggcaauauucacaaaguacgaccaagauggagaccaagaacugaccgaacaugaacaucagcagaugagagacgacuuggagaaagagagggaggaccuggauuuggaucacaguucuuuaccacgucccaugagcagccgaaguuucccucgaagccuggaugacucugaggaggaugacgaugaagauagcggacauagcuccagaaggaggggaagcauuucuaguggcguuucuuacgaagaguuucaaguccuggugagacgaguggaccggauggagcauuccaucggcagcauaguguccaagauugacgccgugaucgugaagcuagagauuauggagcgagccaaacugaagaggagggaggugcugggaaggcuguuggaugggguggccgaggaugaaaggcugggucgugacagugaaauccauagggaacagauggaacggcuaguacgugaagaguuggaacgcugggaauccgaugaugcagcuucccagaucagucaugguuuaggcacgccagugggacuaaauggucaaccucgccccagaagcucccgcccaucuuccucccaaucuacagaaggcauggaaggugcagguggaaaugggaguucuaauguccacguauga

SEQ ID NO: 9251 - RNA, 2907 nt, Artificial Sequence
  derived and/or modified sequence opt1 from PKD2__Homo_sapiens__AAC50520
auggugaacagcucccgcguccagccccagcagccgggcgacgccaagcggccgcccgcgccccgcgcgcccgaccccgggcggcugauggccggcugcgccgccgugggggccagccucgcggcccccggcgggcugugcgagcagcgcggccuggagaucgagaugcagcggauccgccaggccgccgcgcgggacccgcccgccggcgccgccgccucccccagcccgccccuguccagcugcucccgccaggcguggagccgggacaaccccggguucgaggccgaggaggaggaggaggagguggagggcgaggagggcgggauggucguggagauggacguggaguggcgccccgggucccggcgcagcgccgccuccagcgccgucuccagcgugggcgcgcggucccgcggccucgggggcuaccacggggccggccaccccagcggccggcgccggcgccgggaggaccaggggcccccgugccccucccccgugggcgggggcgacccccugcaccgccaccucccgcuggaggggcagccgccccgggucgccugggccgagcgccuggugcgcggccuccggggccugugggggacccgccugauggaggagagcuccaccaaccgggagaaguaccucaagagcgugcugcgcgagcuggucacguaccuccuguuccugaucgugcucugcauccugaccuacggcaugaugagcuccaacguguacuacuacacccggaugaugagccagcuguuccucgacacccccgucuccaagacggagaagaccaacuucaagacccugagcuccauggaggacuucuggaaguucaccgaggggagccugcucgacggccuguacuggaagaugcagcccuccaaccagacggaggccgacaaccgcagcuucaucuucuacgagaaccugcuccugggggugccccggauccgccagcugcgggugcgcaacggcuccugcagcaucccccaggaccuccgggacgagaucaaggagugcuacgacgucuacuccgugagcuccgaggaccgcgcgcccuucggcccgcggaacgggaccgccuggaucuacaccagcgagaaggaccugaacggcuccagccacugggggaucaucgccaccuacuccggcgccggguacuaccuggaccucagccgcacgcgggaggagaccgccgcccagguggccucccugaagaagaacgucuggcuggaccgcggcacccgggccaccuucaucgacuucagcguguacaacgccaacaucaaccucuucugcgugguccgccugcugguggaguuccccgcgacgggcggggucauccccagcuggcaguuccagccgcucaagcugauccgguacgugaccaccuucgacuucuuccuggccgccugcgagaucaucuucugcuucuucaucuucuacuacguggucgaggagauccucgagauccgcauccacaagcugcacuacuuccgcuccuucuggaacugccuggacguggugaucgucgugcucagcguggucgccaucggcaucaacaucuaccggaccuccaacguggaggugcugcugcaguuccucgaggaccagaacacguuccccaacuucgagcaccuggccuacuggcagauccaguucaacaacaucgcggccgucaccguguucuucguguggaucaagcuguucaaguucaucaacuucaaccgcaccaugagccagcuguccaccacgaugagccggugcgccaaggaccucuucggguucgccaucauguucuucaucaucuuccuggccuacgcgcagcuggccuaccucgucuucggcacccagguggacgacuucuccaccuuccaggagugcaucuucacccaguuccgcaucauccugggcgacaucaacuucgccgagaucgaggaggccaaccgggugcuggggcccaucuacuucacgaccuucgucuucuucauguucuucauccuccugaacauguuccuggccaucaucaacgacaccuacagcgaggugaaguccgaccucgcgcagcagaaggccgagauggagcugagcgaccugauccgcaagggcuaccacaaggcccucgugaagcugaagcugaagaagaacaccgucgacgacaucuccgagagccuccggcagggcggcgggaagcugaacuucgacgagcugcgccaggaccucaaggggaagggccacacggacgccgagaucgaggcgaucuucaccaaguacgaccaggacggggaccaggagcugaccgagcacgagcaccagcagaugcgggacgaccuggagaaggagcgcgaggaccucgaccuggaccacuccagccugccccggccgauguccagccgcuccuucccccggagccucgacgacagcgaggaggacgacgacgaggacuccggccacagcucccgccggcgcgggagcaucuccagcggcguguccuacgaggaguuccaggugcugguccggcgcguggaccggauggagcacagcaucggguccaucgugagcaagaucgacgccgucaucgugaagcuggagaucauggagcgcgccaagcucaagcggcgcgaggugcugggccgccugcucgacggcgucgccgaggacgagcggcuggggcgcgacuccgagauccaccgggagcagauggagcgccuggugcgggaggagcucgagcgcugggagagcgacgacgccgcgucccagaucagccacggccuggggacccccgugggccugaacgggcagccccggccgcgcuccagccggcccuccagcucccagagcacggagggcauggagggcgccgggggcaacgggagcuccaacguccacguguga

SEQ ID NO: 9252 - RNA, 2907 nt, Artificial Sequence
  derived and/or modified sequence opt2 from PKD2__Homo_sapiens__AAC50520
auggucaacuccucccgcguccagccccagcagcccggcgacgccaagcgcccccccgccccccgcgcccccgaccccggccgccucauggccggcugcgccgccgucggcgccucccucgccgcccccggcggccucugcgagcagcgcggccucgagaucgagaugcagcgcauccgccaggccgccgcccgcgacccccccgccggcgccgccgccucccccucccccccccucuccuccugcucccgccaggccuggucccgcgacaaccccggcuucgaggccgaggaggaggaggaggaggucgagggcgaggagggcggcauggucgucgagauggacgucgaguggcgccccggcucccgccgcuccgccgccuccuccgccgucuccuccgucggcgcccgcucccgcggccucggcggcuaccacggcgccggccaccccuccggccgccgccgccgccgcgaggaccagggcccccccugccccucccccgucggcggcggcgacccccuccaccgccaccucccccucgagggccagcccccccgcgucgccugggccgagcgccucguccgcggccuccgcggccucuggggcacccgccucauggaggaguccuccaccaaccgcgagaaguaccucaaguccguccuccgcgagcucgucaccuaccuccucuuccucaucguccucugcauccucaccuacggcaugauguccuccaacgucuacuacuacacccgcaugaugucccagcucuuccucgacacccccgucuccaagaccgagaagaccaacuucaagacccucuccuccauggaggacuucuggaaguucaccgagggcucccuccucgacggccucuacuggaagaugcagcccuccaaccagaccgaggccgacaaccgcuccuucaucuucuacgagaaccuccuccucggcgucccccgcauccgccagcuccgcguccgcaacggcuccugcuccaucccccaggaccuccgcgacgagaucaaggagugcuacgacgucuacuccgucuccuccgaggaccgcgcccccuucggcccccgcaacggcaccgccuggaucuacaccuccgagaaggaccucaacggcuccucccacuggggcaucaucgccaccuacuccggcgccggcuacuaccucgaccucucccgcacccgcgaggagaccgccgcccaggucgccucccucaagaagaacgucuggcucgaccgcggcacccgcgccaccuucaucgacuucuccgucuacaacgccaacaucaaccucuucugcgucguccgccuccucgucgaguuccccgccaccggcggcgucauccccuccuggcaguuccagccccucaagcucauccgcuacgucaccaccuucgacuucuuccucgccgccugcgagaucaucuucugcuucuucaucuucuacuacgucgucgaggagauccucgagauccgcauccacaagcuccacuacuuccgcuccuucuggaacugccucgacgucgucaucgucguccucuccgucgucgccaucggcaucaacaucuaccgcaccuccaacgucgagguccuccuccaguuccucgaggaccagaacaccuuccccaacuucgagcaccucgccuacuggcagauccaguucaacaacaucgccgccgucaccgucuucuucgucuggaucaagcucuucaaguucaucaacuucaaccgcaccaugucccagcucuccaccaccaugucccgcugcgccaaggaccucuucggcuucgccaucauguucuucaucaucuuccucgccuacgcccagcucgccuaccucgucuucggcacccaggucgacgacuucuccaccuuccaggagugcaucuucacccaguuccgcaucauccucggcgacaucaacuucgccgagaucgaggaggccaaccgcguccucggccccaucuacuucaccaccuucgucuucuucauguucuucauccuccucaacauguuccucgccaucaucaacgacaccuacuccgaggucaaguccgaccucgcccagcagaaggccgagauggagcucuccgaccucauccgcaagggcuaccacaaggcccucgucaagcucaagcucaagaagaacaccgucgacgacaucuccgagucccuccgccagggcggcggcaagcucaacuucgacgagcuccgccaggaccucaagggcaagggccacaccgacgccgagaucgaggccaucuucaccaaguacgaccaggacggcgaccaggagcucaccgagcacgagcaccagcagaugcgcgacgaccucgagaaggagcgcgaggaccucgaccucgaccacuccucccucccccgccccauguccucccgcuccuucccccgcucccucgacgacuccgaggaggacgacgacgaggacuccggccacuccucccgccgccgcggcuccaucuccuccggcgucuccuacgaggaguuccagguccucguccgccgcgucgaccgcauggagcacuccaucggcuccaucgucuccaagaucgacgccgucaucgucaagcucgagaucauggagcgcgccaagcucaagcgccgcgagguccucggccgccuccucgacggcgucgccgaggacgagcgccucggccgcgacuccgagauccaccgcgagcagauggagcgccucguccgcgaggagcucgagcgcugggaguccgacgacgccgccucccagaucucccacggccucggcacccccgucggccucaacggccagccccgcccccgcuccucccgccccuccuccucccaguccaccgagggcauggagggcgccggcggcaacggcuccuccaacguccacgucuga

SEQ ID NO: 9253 - RNA, 2907 nt, Artificial Sequence
  derived and/or modified sequence opt3 from PKD2__Homo_sapiens__AAC50520
auggugaacagcuccagaguccagccccaacagccuggcgacgccaagaggccaccggcuccccgggcaccugauccagggcgccugauggccggaugcgcggcuguuggugccucucucgcagcccccggcgggcuuugugagcagcgaggacuggaaaucgagaugcagcguauuagacaagcugcagccagggacccuccagcuggcgccgcggcaucacccaguccuccauugagcuccugcucucggcaggccuggucgcgcgauaauccggguuucgaagcugaggaagaggaggaagagguggaaggggaggagggaggcaugguaguggaaauggacgucgaguggagacccggcucaaggcggagcgccgcaaguuccgcugugucuagcguuggggcccgcucccgaggauuagguggcuaccacggggcgggacauccuucaggcagaaggcggcgucgcgaagaucaggguccacccuguccuaguccagucgggggaggcgacccccugcacagacaucuaccgcucgagggccagccucccaggguggccugggcagaacggcuggugcgagggcuucgcggacugugggguaccagauugauggaggagagcucuacaaacagggaaaaauaucucaaguccguacugcgggagcugguuacuuaccucuuauuucugauagugcuuugcaucuugacguauggcaugaugucaagcaaugucuacuauuacacccgcaugaugagucaacuguuccuagauacaccagugucuaaaacugaaaagaccaacuuuaaaacacucuccagcauggaggacuucuggaaguuuaccgaagggucgcugcuugauggacuguauuggaagaugcagccuucuaaucagacugaggcugacaacagauccuucauuuucuacgagaauuugcuccugggcgugcccaggauccgucaguuacggguccgaaacgguucauguaguauuccacaagaucugagagacgaaaucaaagagugcuacgauguuuauagcguguccucugaagacagggcccccuucgggccucgcaauggcacagcuuggauauacaccagcgagaaggaccucaacggaucaagucacuggggcaucauugccacguauuccggggcaggauacuaucuugaucugagccggacuagagaagagaccgccgcucagguagcgucuuugaaaaagaauguguggcuagacagggguacacgcgcaacuuuuaucgauuucucagucuacaacgccaauauuaaccuguuuugugugguucgacuccugguggaguucccagcuaccggcggggucaucccgaguuggcaguuucaaccccuuaaacugauacgguaugugacaaccuucgacuucuuuuuggccgcaugcgaaauuaucuucugcuuuuucaucuuuuacuacguaguugaggaaauucucgagauccguauucauaagcugcacuauuucaggagcuuuuggaauuguuuagauguggucauagugguccuguccgugguugccaucggaauuaacaucuacagaacgucuaacguggagguacuacuccaguuccuggaagaccagaauacuuuuccuaacuucgagcaccuugcuuauuggcagauacaauuuaauaacauugccgcagucacaguguucuuuguuuggaucaaguuguucaaauucaucaauuuuaaccgcaccaugucgcagcugagcacuacaaugucccggugugcgaaggaucucuucggcuuugcuauuauguucuuuaucauuuuccuggccuacgcacagcuugccuaucugguguuugguacccaggucgacgauuucucaacguuucaagaaugcauauucacccaguuuagaaucauuuugggggacaucaauuucgcugagaucgaagaggccaacagggugcucggcccaauuuacuuuacaacuuucguauucuuuauguucuuuauacuguuaaauauguuccuggcaaucauuaacgauaccuauagugaggugaaaucugaccuagcucagcagaaggccgaaauggagcucagcgaccugauccgaaaaggauaccauaaggcgcuuguuaaauugaagcugaagaaaaauacagucgaugacauuuccgaaucacuccgccaaggcgggggaaagcugaacuuugaugaguuacggcaggaccugaaagguaagggccacacugaugccgaaaucgaggcuauauucaccaaauacgaccaggauggggaccaggagcuuacagaacaugagcaccaacagaugagagaugacuuggaaaaggagagggaagaucucgaccuggaucacagcucucuaccccguccuauguccagucgcagcuuuccacggucucuggacgacuccgaggaggaugacgaugaagacucaggacauaguagcagaaggcgaggcucgaucuccucuggugugagcuaugaggaauuucaggugcucguccggcgcguugauagaauggagcacucaauugggaguaucguguccaagauugacgcagugaucguaaaacuggagauaauggaaagggccaaacuuaagcggcgagaggucuugggcagacuguuagauggaguggcugaagacgagcgccucggcagggauucugaaauucaucgugagcaaauggagcggcugguuagagaggaacuugaaaggugggagagcgacgaugccgcaucccagaucucacacgggcugggaacccccgugggcuugaauggucagccgcgcccucgaagcaguagaccaucuuccagccagucgacugaagggauggagggagcgggcgguaacggcucaucuaauguccauguguga

SEQ ID NO: 9254 - RNA, 2907 nt, Artificial Sequence
  derived and/or modified sequence opt4 from PKD2__Homo_sapiens__AAC50520
auggugaacagcagcagagugcagccccagcagcccggcgacgccaagagaccccccgcccccagagcccccgaccccggcagacugauggccggcugcgccgccgugggcgccagccuggccgcccccggcggccugugcgagcagagaggccuggagaucgagaugcagagaaucagacaggccgccgccagagacccccccgccggcgccgccgccagccccagccccccccugagcagcugcagcagacaggccuggagcagagacaaccccggcuucgaggccgaggaggaggaggaggagguggagggcgaggagggcggcauggugguggagauggacguggaguggagacccggcagcagaagaagcgccgccagcagcgccgugagcagcgugggcgccagaagcagaggccugggcggcuaccacggcgccggccaccccagcggcagaagaagaagaagagaggaccagggcccccccugccccagccccgugggcggcggcgacccccugcacagacaccugccccuggagggccagccccccagaguggccugggccgagagacuggugagaggccugagaggccuguggggcaccagacugauggaggagagcagcaccaacagagagaaguaccugaagagcgugcugagagagcuggugaccuaccugcuguuccugaucgugcugugcauccugaccuacggcaugaugagcagcaacguguacuacuacaccagaaugaugagccagcuguuccuggacacccccgugagcaagaccgagaagaccaacuucaagacccugagcagcauggaggacuucuggaaguucaccgagggcagccugcuggacggccuguacuggaagaugcagcccagcaaccagaccgaggccgacaacagaagcuucaucuucuacgagaaccugcugcugggcgugcccagaaucagacagcugagagugagaaacggcagcugcagcaucccccaggaccugagagacgagaucaaggagugcuacgacguguacagcgugagcagcgaggacagagcccccuucggccccagaaacggcaccgccuggaucuacaccagcgagaaggaccugaacggcagcagccacuggggcaucaucgccaccuacagcggcgccggcuacuaccuggaccugagcagaaccagagaggagaccgccgcccagguggccagccugaagaagaacguguggcuggacagaggcaccagagccaccuucaucgacuucagcguguacaacgccaacaucaaccuguucugcguggugagacugcugguggaguuccccgccaccggcggcgugauccccagcuggcaguuccagccccugaagcugaucagauacgugaccaccuucgacuucuuccuggccgccugcgagaucaucuucugcuucuucaucuucuacuacgugguggaggagauccuggagaucagaauccacaagcugcacuacuucagaagcuucuggaacugccuggacguggugaucguggugcugagcgugguggccaucggcaucaacaucuacagaaccagcaacguggaggugcugcugcaguuccuggaggaccagaacaccuuccccaacuucgagcaccuggccuacuggcagauccaguucaacaacaucgccgccgugaccguguucuucguguggaucaagcuguucaaguucaucaacuucaacagaaccaugagccagcugagcaccaccaugagcagaugcgccaaggaccuguucggcuucgccaucauguucuucaucaucuuccuggccuacgcccagcuggccuaccugguguucggcacccagguggacgacuucagcaccuuccaggagugcaucuucacccaguucagaaucauccugggcgacaucaacuucgccgagaucgaggaggccaacagagugcugggccccaucuacuucaccaccuucguguucuucauguucuucauccugcugaacauguuccuggccaucaucaacgacaccuacagcgaggugaagagcgaccuggcccagcagaaggccgagauggagcugagcgaccugaucagaaagggcuaccacaaggcccuggugaagcugaagcugaagaagaacaccguggacgacaucagcgagagccugagacagggcggcggcaagcugaacuucgacgagcugagacaggaccugaagggcaagggccacaccgacgccgagaucgaggccaucuucaccaaguacgaccaggacggcgaccaggagcugaccgagcacgagcaccagcagaugagagacgaccuggagaaggagagagaggaccuggaccuggaccacagcagccugcccagacccaugagcagcagaagcuuccccagaagccuggacgacagcgaggaggacgacgacgaggacagcggccacagcagcagaagaagaggcagcaucagcagcggcgugagcuacgaggaguuccaggugcuggugagaagaguggacagaauggagcacagcaucggcagcaucgugagcaagaucgacgccgugaucgugaagcuggagaucauggagagagccaagcugaagagaagagaggugcugggcagacugcuggacggcguggccgaggacgagagacugggcagagacagcgagauccacagagagcagauggagagacuggugagagaggagcuggagagaugggagagcgacgacgccgccagccagaucagccacggccugggcacccccgugggccugaacggccagcccagacccagaagcagcagacccagcagcagccagagcaccgagggcauggagggcgccggcggcaacggcagcagcaacgugcacguguga

SEQ ID NO: 9255 - RNA, 2907 nt, Artificial Sequence
  derived and/or modified sequence opt5 from PKD2__Homo_sapiens__AAC50520
auggugaacagcuccagaguccagccccaacagccuggcgacgccaagcggccgcccgcuccucgcgcccccgauccugggagacugauggcgggaugcgcugccguuggcgccucucucgcugcccccgggggacugugugagcagcggggccuugaaaucgagaugcagcgcauuagacaagcugccgcgcgggacccuccggccggggcugccgcuagccccuccccuccccugucuagcugcucccgccaggccuggucuagagauaauccuggauucgaagcggaggaagaggaggaagagguggaaggcgaggagggcgggaugguggucgaaauggacguggaguggcggcccggaagccgcagauccgccgcuagcucugccguuuccagcgugggcgcucggucucgcgggcucggaggcuaccacggggccggacauccguccggcagacggcgcagacgggaagaucagggcccucccuguccuagccccgucgggggaggcgacccccugcacagacaucuuccucuggaggggcagccgccccgcguggccugggcugaacggcucguuagaggacugcgcggccugugggggacccggcucauggaggagucuuccacaaacagagaaaaauaucuuaagagcgugcuucgcgagcuggucacguaccuccuguuucuuaucgugcugugcauucucaccuauggaaugauguccucuaauguguacuauuacacacggaugaugagccaacuguuccuggauaccccugucuccaaaacagaaaagaccaacuuuaaaacacucagcucuauggaggacuucuggaaguuuaccgaaggcucccugcuugauggccuguauuggaagaugcagcccagcaaucagacggaggcggacaacagaucuuucaucuuuuacgagaaucuccugcuugggguuccucgcauucggcagcugagagugcgcaacggaagcuguuccaucccccaagaucuccgggacgaaaucaaagagugcuacgauguguauucugucagcuccgaagacagagccccguucggcccucggaaugggaccgcuuggauuuacacaagcgagaaggaccugaacggaucuucccacuggggcaucauugccaccuauagcggggccggcuacuaucuggaucucucucgcacaagagaagagaccgcugcccagguggcgucccugaaaaagaauguuuggcuugaccggggaacgagagcuacauuuaucgauuucagcguguacaacgccaauauuaaccuguuuugugucgugcgccuccugguugaguuccccgccaccggcggggugaucccuuccuggcaguuucaaccccuuaaacugauucgguaugucacaaccuucgacuucuuucucgcugccugcgaaaucaucuucuguuucuucaucuuuuacuacguggucgaggaaauucuggagauuagaauccauaagcugcacuauuuccgcucuuuuuggaauugccucgaugugguuauugugguccugagcgugguugcuaucggaaucaacauuuacagaaccuccaacguggagguccuucugcaguuccucgaagaccagaauacauuuccuaacuucgagcaccuggccuauuggcagauccaauuuaauaacauugcggccgugacgguguucuuuguuuggaucaagcuguucaaauucauuaauuuuaaccggaccaugucucagcuuagcacaaccaugucccgcugugcuaaggaucucuucggcuuugccaucauguucuuuaucauuuuccuggcuuacgcccagcuggcguaucucgucuuugggacacagguggacgauuucagcaccuuucaagaaugcaucuucacgcaguuuagaauuauccugggagacauuaauuucgccgagaucgaagaggcuaaccgggugcuuggccccauuuacuuuacaaccuucgucuucuuuauguucuuuauccugcucaauauguuccuggccaucauuaacgauaccuauucugaggugaaauccgaccuggcucagcagaaggccgaaauggagcuuagcgaccucauccgcaaaggguaccauaaggcccugguuaaacugaagcucaagaaaaauacaguggaugacauuucugaaucccugagacaaggcggaggcaagcugaacuuugaugagcugcggcaggaccucaaagggaagggacacaccgaugcugaaaucgaggcgauuuucacaaaauacgaccaggauggcgaccaggagcugacggaacaugagcaccaacagaugcgcgaugaccuggaaaaggagagagaagaucuugaccucgaucacagcucucugccgcggccuaugagcucccgcagcuuucccagaucucuggacgacuccgaggaggaugacgaugaagacagcgggcauuccucucggagacgcggaagcaucuccucuggcgucagcuaugaggaauuucaggugcucguucggagaguggaucgcauggagcacuccaucgggucuauugucagcaagaucgacgccgugauuguuaaacuggagaucauggaacgggcuaaacuuaagagacgcgaggugcugggccggcuccuggauggagucgccgaagacgagagacugggccgcgauuccgaaauucaucgggagcaaauggagagacuugugcgggaggaacucgaacgcugggagagcgacgaugccgcuucucagaucucccacgggcugggaacccccgugggccugaaugggcagccuagaccgcggagcucucgccccuccagcucucaguccacagaaggaauggagggcgccgggggcaacggaagcuccaauguccauguuuga

SEQ ID NO: 9256 - protein, 942 aa, Artificial Sequence
  PKN1__Homo_sapiens__Q16512
MASDAVQSEPRSWSLLEQLGLAGADLAAPGVQQQLELERERLRREIRKELKLKEGAENLRRATTDLGRSLGPVELLLRGSSRRLDLLHQQLQELHAHVVLPDPAATHDGPQSPGAGGPTCSATNLSRVAGLEKQLAIELKVKQGAENMIQTYSNGSTKDRKLLLTAQQMLQDSKTKIDIIRMQLRRALQAGQLENQAAPDDTQGSPDLGAVELRIEELRHHFRVEHAVAEGAKNVLRLLSAAKAPDRKAVSEAQEKLTESNQKLGLLREALERRLGELPADHPKGRLLREELAAASSAAFSTRLAGPFPATHYSTLCKPAPLTGTLEVRVVGCRDLPETIPWNPTPSMGGPGTPDSRPPFLSRPARGLYSRSGSLSGRSSLKAEAENTSEVSTVLKLDNTVVGQTSWKPCGPNAWDQSFTLELERARELELAVFWRDQRGLCALKFLKLEDFLDNERHEVQLDMEPQGCLVAEVTFRNPVIERIPRLRRQKKIFSKQQGKAFQRARQMNIDVATWVRLLRRLIPNATGTGTFSPGASPGSEARTTGDISVEKLNLGTDSDSSPQKSSRDPPSSPSSLSSPIQESTAPELPSETQETPGPALCSPLRKSPLTLEDFKFLAVLGRGHFGKVLLSEFRPSGELFAIKALKKGDIVARDEVESLMCEKRILAAVTSAGHPFLVNLFGCFQTPEHVCFVMEYSAGGDLMLHIHSDVFSEPRAIFYSACVVLGLQFLHEHKIVYRDLKLDNLLLDTEGYVKIADFGLCKEGMGYGDRTSTFCGTPEFLAPEVLTDTSYTRAVDWWGLGVLLYEMLVGESPFPGDDEEEVFDSIVNDEVRYPRFLSAEAIGIMRRLLRRNPERRLGSSERDAEDVKKQPFFRTLGWEALLARRLPPPFVPTLSGRTDVSNFDEEFTGEAPTLSPPRDARPLTAAEQAAFLDFDFVAGGC

SEQ ID NO: 9257 - RNA, 2829 nt, Artificial Sequence
  PKN1__Homo_sapiens__BAA05169
auggccagcgacgccgugcagagugagccucgcagcuggucccugcuagagcagcugggccuggccggggcagaccuggcggcccccgggguacagcagcagcuggagcuggagcgggagcggcugcggcgggaaauccgcaaggagcugaagcugaaggagggugcugagaaccugcggcgggccaccacugaccugggccgcagccugggccccguagagcugcugcugcggggcuccucgcgccgccucgaccugcugcaccagcagcugcaggagcugcacgcccacguggugcuucccgacccggcggccacccacgauggcccccaguccccuggugcggguggccccaccugcucggccaccaaccugagccgcguggcgggccuggagaagcaguuggccauugagcugaaggugaagcagggggcggagaacaugauccagaccuacagcaauggcagcaccaaggaccggaagcugcugcugacagcccagcagauguugcaggacaguaagaccaagauugacaucauccgcaugcaacuccgccgggcgcugcaggccggccagcuggagaaccaggcagccccggaugacacccaagggaguccugaccugggggcuguggagcugcgcaucgaagagcugcggcaccacuuccgaguggagcacgcgguggccgagggugccaagaacguacugcgccugcucagcgcugccaaggccccggaccgcaaggcagucagcgaggcccaggagaaauugacagaauccaaccagaagcuggggcugcugcgggaggcucuggagcggagacuuggggagcugcccgccgaccaccccaaggggcggcugcugcgagaagagcucgcugcggccuccuccgcugccuucagcacccgccuggccgggcccuuucccgccacgcacuacagcacccugugcaagcccgcgccgcucacagggacccuggagguacgaguggugggcugcagagaccucccagagaccaucccguggaacccuacccccucaauggggggaccugggaccccagacagccgcccccccuuccugagccgcccagcccggggccuuuacagccgaagcggaagccucaguggccggagcagccucaaagcagaagccgagaacaccagugaagucagcacugugcuuaagcuggauaacacagugguggggcagacgucuuggaagccauguggccccaaugccugggaccagagcuucacucuggagcuggaaagggcacgggaacuggaguuggcuguguucuggcgggaccagcggggccugugugcccucaaauuccugaaguuggaggauuucuuggacaaugagaggcaugaggugcagcuggacauggaaccccagggcugccugguggcugaggucaccuuccgcaacccugucauugagaggauuccucggcuccgacggcagaagaaaauuuucuccaagcagcaagggaaggcguuccagcgugcuaggcagaugaacaucgaugucgccacgugggugcggcugcuccggaggcucauccccaaugccacgggcacaggcaccuuuagcccuggggcuucuccaggauccgaggcccggaccacgggugacauaucgguggagaagcugaaccucggcacugacucggacagcucaccucagaagagcucgcgggauccuccuuccagcccaucgagccugagcucccccauccaggaauccacugcucccgagcugccuucggagacccaggagaccccaggccccgcccugugcagcccucugaggaagucaccucugacccucgaagauuucaaguuccuggcggugcugggccggggucauuuugggaaggugcuccucuccgaauuccggcccaguggggagcuguucgccaucaaggcucugaagaaaggggacauuguggcccgagacgagguggagagccugaugugugagaagcggauauuggcggcagugaccagugcgggacaccccuuccuggugaaccucuucggcuguuuccagacaccggagcacgugugcuucgugauggaguacucggccgguggggaccugaugcugcacauccacagcgacguguucucugagccccgugccaucuuuuauuccgccugcguggugcugggccuacaguuucuucacgaacacaagaucgucuacagggaccugaaguuggacaauuugcuccuggacaccgagggcuacgucaagaucgcagacuuuggccucugcaaggaggggaugggcuauggggaccggaccagcacauucugugggaccccggaguuccuggccccugaggugcugacggacacgucguacacgcgagcuguggacugguggggacugggugugcugcucuacgagaugcugguuggcgaguccccauucccaggggaugaugaggaggaggucuucgacagcaucgucaacgacgagguucgcuacccccgcuuccugucggccgaagccaucggcaucaugagaaggcugcuucggaggaacccagagcggaggcugggaucuagcgagagagaugcagaagaugugaagaaacagcccuucuucaggacucugggcugggaagcccuguuggcccggcgccugccaccgcccuuugugcccacgcuguccggccgcaccgacgucagcaacuucgacgaggaguucaccggggaggcccccacacugagcccgccccgcgacgcgcggccccuuacagccgcggagcaggcagccuuccuggacuucgacuucguggccgggggcugcuag

SEQ ID NO: 9258 - RNA, 2829 nt, Artificial Sequence
  derived and/or modified sequence opt1 from PKN1__Homo_sapiens__BAA05169
auggccagcgacgccgugcaguccgagccccgcagcuggucccugcucgagcagcugggccuggcgggggccgaccucgccgccccgggcguccagcagcagcuggagcuggagcgggagcgccuccggcgcgagauccggaaggagcugaagcugaaggagggggccgagaaccuccgccgggcgaccaccgaccugggccgcagccuggggcccguggagcuccugcugcggggcuccagccgccggcucgaccugcugcaccagcagcuccaggagcugcacgcccacgugguccugcccgaccccgccgccacgcacgacggcccgcagucccccggggcgggcgggccgaccugcagcgccaccaaccucucccgcguggccggccuggagaagcagcuggccaucgagcucaaggugaagcagggggccgagaacaugauccagaccuacagcaacggcuccacgaaggaccggaagcugcugcucaccgcgcagcagaugcugcaggacagcaagaccaagaucgacaucauccgcaugcagcugcggcgcgcccuccaggccggccagcuggagaaccaggccgcccccgacgacacccaggggucccccgaccugggcgcggucgagcuccggaucgaggagcugcgccaccacuuccggguggagcacgccguggccgagggggccaagaacguccugcgccuccugagcgccgcgaaggcccccgaccggaaggccguguccgaggcccaggagaagcugacggagagcaaccagaagcucggccugcugcgcgaggcccucgagcgccggcugggcgagcugcccgcggaccaccccaaggggcgccuccugcgggaggagcuggccgccgccuccagcgcggccuucuccacccgccucgccggcccguuccccgccacccacuacagcacccugugcaagcccgcgccccugacggggacccuggaggugcgggucgugggcugccgcgaccucccggagaccauccccuggaaccccacccccagcaugggcgggccgggcacgcccgacucccggccgcccuuccugagccgccccgcccgggggcuguacucccgcagcggcucccucagcgggcgguccagccugaaggccgaggccgagaacaccuccgaggugagcaccguccugaagcucgacaacaccguggugggccagacguccuggaagcccugcgggcccaacgccugggaccagagcuucacccuggagcuggagcgcgcccgggagcucgagcuggcggucuucuggcgcgaccagcggggccugugcgcccucaaguuccugaagcuggaggacuuccucgacaacgagcgccacgaggugcagcuggacauggagccccagggcugccugguggccgaggucaccuuccggaacccggugaucgagcgcaucccccggcuccgccgccagaagaagaucuucuccaagcagcaggggaaggccuuccagcgggcccgccagaugaacaucgacguggcgaccuggguccggcugcugcgccggcucauccccaacgccacgggcaccgggaccuucagcccgggcgccucccccgggagcgaggcccgcaccacgggcgacaucuccguggagaagcugaaccugggcaccgacagcgacuccagcccccagaaguccagccgggacccgcccagcucccccagcucccucagcucccccauccaggagagcaccgcgcccgagcugccguccgagacccaggagacgcccgggcccgcccugugcagcccccuccgcaaguccccgcugacccuggaggacuucaaguuccucgccguccugggccgggggcacuucggcaaggugcugcucagcgaguuccgccccuccggcgagcuguucgccaucaaggcccugaagaagggggacaucguggcgcgggacgaggucgagagccucaugugcgagaagcgcauccuggccgccgugaccuccgccggccaccccuuccuggugaaccucuucgggugcuuccagacccccgagcacgucugcuucgugauggaguacagcgccggcggggaccugaugcugcacauccacuccgacguguucagcgagccgcgggcgaucuucuacagcgccugcgucgugcucggccugcaguuccugcacgagcacaagaucguguaccgcgaccucaagcuggacaaccugcuccuggacacggagggcuacgucaagaucgccgacuucgggcugugcaaggagggcaugggguacggcgaccggaccuccaccuucugcgggacccccgaguuccucgcccccgaggugcugaccgacacgagcuacacccgcgccguggacugguggggccugggcguccuccuguacgagaugcuggugggggagucccccuucccgggcgacgacgaggaggagguguucgacagcaucgucaacgacgaggugcgguacccccgcuuccucuccgcggaggccaucgggaucaugcggcgccugcugcggcgcaaccccgagcgccggcucggcagcuccgagcgcgacgccgaggacgugaagaagcagcccuucuuccggacccuggggugggaggcccugcucgcgcgccggcugccgccgcccuucguccccacccugagcggccgcacggacguguccaacuucgacgaggaguucaccggcgaggcccccacccucagcccgccccgggacgcccgcccccugaccgccgccgagcaggcggccuuccuggacuucgacuucguggccgggggcugcuga

SEQ ID NO: 9259 - RNA, 2829 nt, Artificial Sequence
  derived and/or modified sequence opt2 from PKN1__Homo_sapiens__BAA05169
auggccuccgacgccguccaguccgagccccgcuccuggucccuccucgagcagcucggccucgccggcgccgaccucgccgcccccggcguccagcagcagcucgagcucgagcgcgagcgccuccgccgcgagauccgcaaggagcucaagcucaaggagggcgccgagaaccuccgccgcgccaccaccgaccucggccgcucccucggccccgucgagcuccuccuccgcggcuccucccgccgccucgaccuccuccaccagcagcuccaggagcuccacgcccacgucguccuccccgaccccgccgccacccacgacggcccccagucccccggcgccggcggccccaccugcuccgccaccaaccucucccgcgucgccggccucgagaagcagcucgccaucgagcucaaggucaagcagggcgccgagaacaugauccagaccuacuccaacggcuccaccaaggaccgcaagcuccuccucaccgcccagcagaugcuccaggacuccaagaccaagaucgacaucauccgcaugcagcuccgccgcgcccuccaggccggccagcucgagaaccaggccgcccccgacgacacccagggcucccccgaccucggcgccgucgagcuccgcaucgaggagcuccgccaccacuuccgcgucgagcacgccgucgccgagggcgccaagaacguccuccgccuccucuccgccgccaaggcccccgaccgcaaggccgucuccgaggcccaggagaagcucaccgaguccaaccagaagcucggccuccuccgcgaggcccucgagcgccgccucggcgagcuccccgccgaccaccccaagggccgccuccuccgcgaggagcucgccgccgccuccuccgccgccuucuccacccgccucgccggccccuuccccgccacccacuacuccacccucugcaagcccgccccccucaccggcacccucgagguccgcgucgucggcugccgcgaccuccccgagaccauccccuggaaccccacccccuccaugggcggccccggcacccccgacucccgcccccccuuccucucccgccccgcccgcggccucuacucccgcuccggcucccucuccggccgcuccucccucaaggccgaggccgagaacaccuccgaggucuccaccguccucaagcucgacaacaccgucgucggccagaccuccuggaagcccugcggccccaacgccugggaccaguccuucacccucgagcucgagcgcgcccgcgagcucgagcucgccgucuucuggcgcgaccagcgcggccucugcgcccucaaguuccucaagcucgaggacuuccucgacaacgagcgccacgagguccagcucgacauggagccccagggcugccucgucgccgaggucaccuuccgcaaccccgucaucgagcgcaucccccgccuccgccgccagaagaagaucuucuccaagcagcagggcaaggccuuccagcgcgcccgccagaugaacaucgacgucgccaccuggguccgccuccuccgccgccucauccccaacgccaccggcaccggcaccuucucccccggcgccucccccggcuccgaggcccgcaccaccggcgacaucuccgucgagaagcucaaccucggcaccgacuccgacuccuccccccagaaguccucccgcgacccccccuccucccccuccucccucuccucccccauccaggaguccaccgcccccgagcuccccuccgagacccaggagacccccggccccgcccucugcuccccccuccgcaaguccccccucacccucgaggacuucaaguuccucgccguccucggccgcggccacuucggcaagguccuccucuccgaguuccgccccuccggcgagcucuucgccaucaaggcccucaagaagggcgacaucgucgcccgcgacgaggucgagucccucaugugcgagaagcgcauccucgccgccgucaccuccgccggccaccccuuccucgucaaccucuucggcugcuuccagacccccgagcacgucugcuucgucauggaguacuccgccggcggcgaccucaugcuccacauccacuccgacgucuucuccgagccccgcgccaucuucuacuccgccugcgucguccucggccuccaguuccuccacgagcacaagaucgucuaccgcgaccucaagcucgacaaccuccuccucgacaccgagggcuacgucaagaucgccgacuucggccucugcaaggagggcaugggcuacggcgaccgcaccuccaccuucugcggcacccccgaguuccucgcccccgagguccucaccgacaccuccuacacccgcgccgucgacugguggggccucggcguccuccucuacgagaugcucgucggcgagucccccuuccccggcgacgacgaggaggaggucuucgacuccaucgucaacgacgagguccgcuacccccgcuuccucuccgccgaggccaucggcaucaugcgccgccuccuccgccgcaaccccgagcgccgccucggcuccuccgagcgcgacgccgaggacgucaagaagcagcccuucuuccgcacccucggcugggaggcccuccucgcccgccgccuccccccccccuucguccccacccucuccggccgcaccgacgucuccaacuucgacgaggaguucaccggcgaggcccccacccucucccccccccgcgacgcccgcccccucaccgccgccgagcaggccgccuuccucgacuucgacuucgucgccggcggcugcuga

SEQ ID NO: 9260 - RNA, 2829 nt, Artificial Sequence
  derived and/or modified sequence opt3 from PKN1__Homo_sapiens__BAA05169
auggccagcgacgcugugcaguccgagcccagaucuuggucacugcucgaacaacuuggccuggcaggggccgauuuggcggcuccuggaguccagcagcaguuagagcuggaaagggagcggcuacgccgagaaauccguaaggagcucaaacugaaggagggugccgaaaaccuuagaagggcaaccacagaccugggccggaguuuggggccaguugagcuccugcugcgcggaagcuccagaaggcucgauuuacugcaccaacagcuucaggaauugcaugcccacgugguacugccggaccccgcugcaacucaugauggcccucagucuccaggugccgggggacccacgugcucggcuaccaaucuaucacggguggccggccucgagaaacaacuggcgauugagcuuaaggucaaacagggcgcagaaaacaugauacagacauacagcaaugggaguacuaaggaccgcaagcuguugcucaccgcccagcaaaugcugcaggauuccaaaacaaagaucgacauuauccgaaugcaguuaagaagggcucugcaagccggacagcucgagaaccaggcagcuccugaugacacccaggguucuccagaucuuggcgccguggaacugcggauugaggaauugcgucaccauuuccgcguugagcacgcgguggccgagggggcaaagaauguccuaagacugcucagcgcugccaaggcucccgacaggaaagccguguccgaagcacaagagaagcugacugaaucaaaccagaaacuuggacuguugcgggaggcccucgaacgacgccugggcgaguuaccugcugaucacccaaaagguagacugcuaagggaggaacucgcggcagccaguagcgcugccuuuucuacacggcuggcagggccguuccccgccacccauuauuccacgcuuuguaagccugcuccauugacuggaacccuggagguacgcguugugggcugcagagaccuccccgaaacaaucccuuggaauccaacucccucaaugggcgggccgggaaccccugacagcaggcccccauuucugagucguccugcccggggucuuuacucucgauccggcagccugucggggagaucuuccuugaaagcagaggcggaaaacacaucagaggucaguaccgugcucaagcuggauaauacgguggucggacagacuagcuggaaacccuguggcccaaacgcuugggaccaguccuucacauuagagcuggaaagggcccgcgagcuagaacucgcaguuuucuggcgggaucaaagaggucugugcgcccuuaaguucuugaaacuggaggacuuucucgauaaugagaggcacgaagugcagcuggacauggagccccagggguguuuaguagcugaagugaccuuccgcaacccugucauagagcgaaucccacggcugcguagacagaagaagaucuuuucuaaacaacagggcaaggccuuccagagggcacgccagaugaauauugauguggcuacuuggguucggcuuuugagaaggcucauuccgaacgccacaggaaccggcacguuuagccccggggcgucaccuggaagugaagcccgaaccacaggugacaucuccguggagaaacugaaucuaggcacugauagcgacucuucaccacaaaagaguagccgcgaucccccuuccucuccaucgagccuguccucacccauacaggagaguaccgcuccggaacucccuucugagacacaggaaacuccagggcccgcacugugcagcccucuucggaaaucccccuugacccuggaggacuucaaguuuuuagccguccucggaagaggccauuucgguaaggugcugcuuucagaauuuaggccaagcggggagcuguuugcuauuaaagccuugaagaaaggcgacaucguagcacgugaugagguugaaucucucaugugugagaagcgcauucuggcggccgugacauccgcuggacacccuuuccuagucaaccuguuuggcugcuuccaaacccccgaacacguguguuuugucauggaguauagugccgggggagaccucaugcugcauauccacagcgauguguucucugaaccacgggcaaucuuuuacuccgcuugcguugugcuugguuugcaguuccugcaugagcacaaaauuguauauagagacuuaaagcucgauaaccugcuucuggacacugagggcuacgucaagauagccgauuuugggcuauguaaagaaggaaugggcuauggugacaggacgucaacauucugcgggaccccggaguuucucgcaccugaagugcugacugauaccaguuacacacgagccguugacugguggggcuugggagugcuguuauacgagaugcucgucggcgagagccccuucccaggggaugacgaagaggaaguguuugauucgaucguaaaugacgaggugcgguauccccgcuuccuguccgcugaagcgauuggaaucaugagaaggcuucugcggcgaaacccugagagacgcuugggcucuagcgagagggacgccgaagauguuaagaaacagccauucuuucguacccucgguugggaggcacugcuagcucggagacugcccccuccguucgucccaacucuuucagggaggacagacgugaguaauuuugaugaagaguucacgggagaagcccccacccucuccccuccacgcgacgcccgaccccugacugcugcagagcaggccgcguuuuuggauuucgacuuuguggcuggcgguugcuga

SEQ ID NO: 9261 - RNA, 2829 nt, Artificial Sequence
  derived and/or modified sequence opt4 from PKN1__Homo_sapiens__BAA05169
auggccagcgacgccgugcagagcgagcccagaagcuggagccugcuggagcagcugggccuggccggcgccgaccuggccgcccccggcgugcagcagcagcuggagcuggagagagagagacugagaagagagaucagaaaggagcugaagcugaaggagggcgccgagaaccugagaagagccaccaccgaccugggcagaagccugggccccguggagcugcugcugagaggcagcagcagaagacuggaccugcugcaccagcagcugcaggagcugcacgcccacguggugcugcccgaccccgccgccacccacgacggcccccagagccccggcgccggcggccccaccugcagcgccaccaaccugagcagaguggccggccuggagaagcagcuggccaucgagcugaaggugaagcagggcgccgagaacaugauccagaccuacagcaacggcagcaccaaggacagaaagcugcugcugaccgcccagcagaugcugcaggacagcaagaccaagaucgacaucaucagaaugcagcugagaagagcccugcaggccggccagcuggagaaccaggccgcccccgacgacacccagggcagccccgaccugggcgccguggagcugagaaucgaggagcugagacaccacuucagaguggagcacgccguggccgagggcgccaagaacgugcugagacugcugagcgccgccaaggcccccgacagaaaggccgugagcgaggcccaggagaagcugaccgagagcaaccagaagcugggccugcugagagaggcccuggagagaagacugggcgagcugcccgccgaccaccccaagggcagacugcugagagaggagcuggccgccgccagcagcgccgccuucagcaccagacuggccggccccuuccccgccacccacuacagcacccugugcaagcccgccccccugaccggcacccuggaggugagaguggugggcugcagagaccugcccgagaccauccccuggaaccccacccccagcaugggcggccccggcacccccgacagcagaccccccuuccugagcagacccgccagaggccuguacagcagaagcggcagccugagcggcagaagcagccugaaggccgaggccgagaacaccagcgaggugagcaccgugcugaagcuggacaacaccguggugggccagaccagcuggaagcccugcggccccaacgccugggaccagagcuucacccuggagcuggagagagccagagagcuggagcuggccguguucuggagagaccagagaggccugugcgcccugaaguuccugaagcuggaggacuuccuggacaacgagagacacgaggugcagcuggacauggagccccagggcugccugguggccgaggugaccuucagaaaccccgugaucgagagaauccccagacugagaagacagaagaagaucuucagcaagcagcagggcaaggccuuccagagagccagacagaugaacaucgacguggccaccugggugagacugcugagaagacugauccccaacgccaccggcaccggcaccuucagccccggcgccagccccggcagcgaggccagaaccaccggcgacaucagcguggagaagcugaaccugggcaccgacagcgacagcagcccccagaagagcagcagagacccccccagcagccccagcagccugagcagccccauccaggagagcaccgcccccgagcugcccagcgagacccaggagacccccggccccgcccugugcagcccccugagaaagagcccccugacccuggaggacuucaaguuccuggccgugcugggcagaggccacuucggcaaggugcugcugagcgaguucagacccagcggcgagcuguucgccaucaaggcccugaagaagggcgacaucguggccagagacgagguggagagccugaugugcgagaagagaauccuggccgccgugaccagcgccggccaccccuuccuggugaaccuguucggcugcuuccagacccccgagcacgugugcuucgugauggaguacagcgccggcggcgaccugaugcugcacauccacagcgacguguucagcgagcccagagccaucuucuacagcgccugcguggugcugggccugcaguuccugcacgagcacaagaucguguacagagaccugaagcuggacaaccugcugcuggacaccgagggcuacgugaagaucgccgacuucggccugugcaaggagggcaugggcuacggcgacagaaccagcaccuucugcggcacccccgaguuccuggcccccgaggugcugaccgacaccagcuacaccagagccguggacugguggggccugggcgugcugcuguacgagaugcuggugggcgagagccccuuccccggcgacgacgaggaggagguguucgacagcaucgugaacgacgaggugagauaccccagauuccugagcgccgaggccaucggcaucaugagaagacugcugagaagaaaccccgagagaagacugggcagcagcgagagagacgccgaggacgugaagaagcagcccuucuucagaacccugggcugggaggcccugcuggccagaagacugcccccccccuucgugcccacccugagcggcagaaccgacgugagcaacuucgacgaggaguucaccggcgaggcccccacccugagcccccccagagacgccagaccccugaccgccgccgagcaggccgccuuccuggacuucgacuucguggccggcggcugcuga

SEQ ID NO: 9262 - RNA, 2829 nt, Artificial Sequence
  derived and/or modified sequence opt5 from PKN1__Homo_sapiens__BAA05169
auggccagcgacgcugugcaguccgagcccagaucuuggagccugcucgaacaacugggccuugccggggcggaucuggcugccccuggaguccagcagcagcucgagcuggaacgggagcgccuuagacgggaaauccgcaaggagcugaaacucaaggagggcgccgaaaaccugagacgggcuaccacagaccuggggcgcucccucggaccgguugagcugcuucugagaggcucuagccggcgccucgaucugcuucaccaacagcugcaggaacuccaugcccacguggugcugcccgacccugcugccacgcaugaugggccccaguccccuggagcgggcggcccuaccugcucugccacaaaucugagcagagucgcugggcucgagaaacaacuggccauugagcuuaaggugaaacagggagcugaaaacaugauccagaccuacuccaauggcagcacaaaggaccggaagcugcuccugaccgcccagcaaaugcuucaggauucuaaaacaaagauugacaucauucgcaugcagcugagacgggcgcuccaagccgggcagcuggagaaccaggcugcccccgaugacacccagggauccccggaucugggcgcuguugaacuccgcaucgaggaacugagacaccauuuccggguggagcacgccgucgccgagggggcuaaaaaugugcuuagacugcucagcgcggccaaggcucccgaccgcaaagccguuucugaagcccaagagaagcugacggaauccaaccagaaacuuggacugcuccgggaggcucuggaaagacgccugggcgagcucccugccgaucaccccaagggccggcugcuuagagaggaacuggcggcugccagcucugccgcuuuuuccacccgccucgccgggccuuuccccgcuacacauuauagcacccuguguaagccggccccucugacaggaacccuugaggugcgggucgugggcugcagagaccuccccgaaacgaucccuuggaaucccacacccuccaugggagggccuggcaccccggacucucggcccccuuuucugagccgccccgcgagagggcuguacucccgcagcggaucucucuccggccggagcucucugaaagccgaggcugaaaacacaagcgagguguccaccguccuuaagcuggauaauaccguugugggccagacaucuuggaaaccuugugggcccaacgccugggaccagagcuucacgcucgagcuggaaagagcucgggagcuggaacuugccguguuuuggcgcgaucaaagaggacucugcgcgcugaaguuccugaaacucgaggacuuucuggauaaugagcggcacgaaguccagcuugacauggagccgcagggcugucugguggccgaaguuaccuucagaaacccugugauugagcgcaucccccggcucagacgccagaagaagauuuucuccaaacaacaggggaaggcuuuccagagagcccggcagaugaauaucgaugucgcuacaugggugcgccugcugagacggcuuauuccuaacgccaccggaacaggcaccuuuagccccggggccucuccuggcuccgaagcucgcacgacaggagacaucagcguugagaaacucaaucugggcaccgauucugacuccagcccccaaaaguccucuagagauccgccuagcucccccucuagccuguccagccccauucaggagucuaccgcgccugaacucccguccgagacacaggaaacccccgggccugcccugugcagcccccuucggaaaucuccucugacacucgaggacuucaaguuucuggcugugcugggacgcggccauuucgggaagguccuucucuccgaauuuagacccagcggagagcuguuugccaucaaagcccugaagaaaggcgacaucguggcucgggaugaggucgaaucucucaugugugagaagcgcauucuggccgcggugacgagcgcugggcacccuuuccuuguuaaccuguuuggcugcuuccaaacccccgaacacguguguuuugucauggaguauuccgccggaggcgaccucaugcugcauauccacagcgauguguucucugaaccgagagccaucuuuuacuccgcuugcguugugcuggggcuucaguuccugcaugagcacaaaauugucuaucgggaccucaagcuggauaaccuccugcuugacacagagggauacgugaagauugccgauuuuggccuguguaaagaagggaugggauauggcgacagaaccagcacauucugcgggaccccugaguuucucgcgcccgaagugcugacggauaccuccuacacacgcgcuguugacugguggggccugggaguccuucuguacgagaugcucgugggcgagucuccuuuccccggggaugacgaagaggaaguguuugauagcaucgucaaugacgaggugcgguauccgagauuccuguccgccgaagccaucggaauuaugcgccggcuccugagacgcaacccugagcggagacuuggcucuagcgagcgcgacgcugaagauguuaagaaacagcccuucuuucggacccuggggugggaggcccuccuggcuagacggcugccuccucccuucgugcccacacuuuccggacgcaccgacgucucuaauuuugaugaagaguucacgggcgaagccccgacacugagcccucccagagacgcgcggccccucaccgccgcugagcaggccgcuuuucuggauuucgacuuuguggccgggggcugcuga

SEQ ID NO: 9263 - protein, 984 aa, Artificial Sequence
  PKN2__Homo_sapiens__Q16513
MASNPERGEILLTELQGDSRSLPFSENVSAVQKLDFSDTMVQQKLDDIKDRIKREIRKELKIKEGAENLRKVTTDKKSLAYVDNILKKSNKKLEELHHKLQELNAHIVVSDPEDITDCPRTPDTPNNDPRCSTSNNRLKALQKQLDIELKVKQGAENMIQMYSNGSSKDRKLHGTAQQLLQDSKTKIEVIRMQILQAVQTNELAFDNAKPVISPLELRMEELRHHFRIEFAVAEGAKNVMKLLGSGKVTDRKALSEAQARFNESSQKLDLLKYSLEQRLNEVPKNHPKSRIIIEELSLVAASPTLSPRQSMISTQNQYSTLSKPAALTGTLEVRLMGCQDILENVPGRSKATSVALPGWSPSETRSSFMSRTSKSKSGSSRNLLKTDDLSNDVCAVLKLDNTVVGQTSWKPISNQSWDQKFTLELDRSRELEISVYWRDWRSLCAVKFLRLEDFLDNQRHGMCLYLEPQGTLFAEVTFFNPVIERRPKLQRQKKIFSKQQGKTFLRAPQMNINIATWGRLVRRAIPTVNHSGTFSPQAPVPTTVPVVDVRIPQLAPPASDSTVTKLDFDLEPEPPPAPPRASSLGEIDESSELRVLDIPGQDSETVFDIQNDRNSILPKSQSEYKPDTPQSGLEYSGIQELEDRRSQQRFQFNLQDFRCCAVLGRGHFGKVLLAEYKNTNEMFAIKALKKGDIVARDEVDSLMCEKRIFETVNSVRHPFLVNLFACFQTKEHVCFVMEYAAGGDLMMHIHTDVFSEPRAVFYAACVVLGLQYLHEHKIVYRDLKLDNLLLDTEGFVKIADFGLCKEGMGYGDRTSTFCGTPEFLAPEVLTETSYTRAVDWWGLGVLIYEMLVGESPFPGDDEEEVFDSIVNDEVRYPRFLSTEAISIMRRLLRRNPERRLGASEKDAEDVKKHPFFRLIDWSALMDKKVKPPFIPTIRGREDVSNFDDEFTSEAPILTPPREPRILSEEEQEMFRDFDYIADWC

SEQ ID NO: 9264 - RNA, 2955 nt, Artificial Sequence
  PKN2__Homo_sapiens__AAB33346
auggcguccaaccccgaacggggggagauucugcucacggaacugcagggggauucccgaagucuuccguuuucugagaaugugagugcuguucaaaaauuagacuuuucagauacaauggugcagcagaaauuggaugauaucaaggaucgaauuaagagagaaauaaggaaagaacugaaaaucaaagaaggagcugaaaaucugaggaaagucacaacagauaaaaaaaguuuggcuuauguagacaacauuuugaaaaaaucaaauaaaaaauuagaagaacuacaucacaagcugcaggaauuaaaugcacauauuguuguaucagauccagaagauauuacagauugcccaaggacuccagauacuccaaauaaugacccucguuguucuacuagcaacaauagauugaaggccuuacaaaaacaauuggauauagaacuuaaaguaaaacaaggugcagagaauaugauacagauguauucaaauggaucuucaaaggaucggaaacuccaugguacagcucagcaacugcuccaggacagcaagacaaaaauagaagucauacgaaugcagauucuucaggcaguccagacuaaugaauuggcuuuugauaaugcaaaaccugugauaaguccucuugaacuucggauggaagaauuaaggcaucauuuuaggauagaguuugcaguagcagaaggugcaaagaauguaaugaaauuacuuggcucaggaaaaguaacagacagaaaagcacuuucagaagcucaagcaagauuuaaugaaucaagucagaaguuggaccuuuuaaaguauucauuagagcaaagauuaaacgaaguccccaagaaucaucccaaaagcaggauuauuauugaagaacuuucacuuguugcugcaucaccaacacuaaguccacgucaaaguaugauaucuacgcaaaaucaauauaguacacuauccaaaccagcagcacuaacagguacuuuggaaguucgucuuaugggcugccaagauauccuagagaaugucccuggacggucaaaagcaacaucaguugcacugccugguuggaguccaagugaaaccagaucaucuuucaugagcagaacgaguaaaaguaaaagcggaaguagucgaaaucuucuaaaaaccgaugacuuguccaaugaugucugugcuguuuugaagcucgauaauacugugguuggccaaacuagcuggaaacccauuuccaaucagucaugggaccagaaguuuacacuggaacuggacaggucacgugaacuggaaauuucaguuuauuggcgugauuggcggucucugugugcuguaaaauuucugagguuagaagauuuuuuagacaaccaacggcauggcaugugucucuauuuggaaccacaggguacuuuauuugcagagguuaccuuuuuuaauccaguuauugaaagaagaccaaaacuucaaagacaaaagaaaauuuuuucaaagcaacaaggcaaaacauuucucagagcuccucaaaugaauauuaauauugccacuuggggaaggcuaguaagaagagcuauuccuacaguaaaucauucuggcaccuucagcccucaagcuccugugccuacuacagugccagugguugauguacgcaucccucaacuagcaccuccagcuagugauucuacaguaaccaaauuggacuuugaucuugagccugaaccuccuccagccccaccacgagcuucuucucuuggagaaauagaugaaucuucugaauuaagaguuuuggauauaccaggacaggauucagagacuguuuuugauauucagaaugacagaaauaguauacuuccaaaaucucaaucugaauacaagccugauacuccucagucaggccuagaauauagugguauucaagaacuugaggacagaagaucucagcaaagguuucaguuuaaucuacaagauuucagguguugugcugucuugggaagaggacauuuuggaaaggugcuuuuagcugaauauaaaaacacaaaugagauguuugcuauaaaagccuuaaagaaaggagauauuguggcucgagaugaaguagacagccugaugugugaaaaaagaauuuuugaaacugugaauaguguaaggcaucccuuuuuggugaaccuuuuugcauguuuccaaaccaaagagcauguuugcuuuguaauggaauaugcugccgguggggaccuaaugaugcacauucauacugaugucuuuucugaaccaagagcuguauuuuaugcugcuuguguaguucuuggguugcaguauuuacaugaacacaaaauuguuuauagagauuugaaauuggauaacuuauugcuagauacagagggcuuugugaaaauugcugauuuuggucuuugcaaagaaggaaugggauauggagauagaacaagcacauuuuguggcacuccugaauuucuugccccagaaguauuaacagaaacuucuuauacaagggcuguagauugguggggccuuggcgugcuuauauaugaaaugcuuguuggugagucucccuuuccuggugaugaugaagaggaaguuuuugacaguauuguaaaugaugaaguaagguauccaagguucuuaucuacagaagccauuucuauaaugagaaggcuguuaagaagaaauccugaacggcgccuuggggcuagcgagaaagaugcagaggauguaaaaaagcacccauuuuuccggcuaauugauuggagcgcucugauggacaaaaaaguaaagccaccauuuauaccuaccauaagaggacgagaagauguuaguaauuuugaugaugaauuuaccucagaagcaccuauucugacuccaccucgagaaccaaggauacuuucggaagaggagcaggaaauguucagagauuuugacuacauugcugauugguguuaa

SEQ ID NO: 9265 - RNA, 2955 nt, Artificial Sequence
  derived and/or modified sequence opt1 from PKN2__Homo_sapiens__AAB33346
auggccagcaaccccgagcgcggcgagauccugcucaccgagcugcagggggacucccggagccugcccuucuccgagaacgugagcgccguccagaagcucgacuucuccgacaccauggugcagcagaagcuggacgacaucaaggaccgcaucaagcgggagauccgcaaggagcugaagaucaaggagggcgcggagaaccuccggaaggugacgaccgacaagaagucccuggccuacgucgacaacauccugaagaaguccaacaagaagcucgaggagcugcaccacaagcugcaggagcucaacgcccacaucguggugagcgaccccgaggacaucaccgacugcccccgcacccccgacacgccgaacaacgacccccggugcuccaccagcaacaaccgccugaaggcccugcagaagcagcucgacaucgagcugaaggucaagcagggggccgagaacaugauccagauguacuccaacggcagcuccaaggaccggaagcugcacgggaccgcgcagcagcuccugcaggacagcaagaccaagaucgaggugauccgcaugcagauccugcaggccgugcagacgaacgagcucgccuucgacaacgccaagcccgucaucagcccccuggagcugcggauggaggagcuccgccaccacuuccggaucgaguucgcgguggccgagggcgccaagaacgugaugaagcugcugggcuccgggaaggucaccgaccgcaaggcccucuccgaggcccaggcgcgguucaacgagagcucccagaagcuggaccugcucaaguacagccuggagcagcgccugaacgaggugccgaagaaccaccccaagagccggaucaucaucgaggagcucucccugguggccgccagccccacccugagcccccgccaguccaugaucuccacccagaaccaguacagcacgcucuccaagccggccgcccugaccggcacccuggagguccggcucauggggugccaggacauccuggagaacgugcccggccgcagcaaggcgaccagcguggcccugcccggguggagccccuccgagacgcggagcuccuucaugagccgcaccuccaagagcaaguccggcagcucccgcaaccuccugaagaccgacgaccugagcaacgacgucugcgccgugcucaagcuggacaacaccguggucggccagacgagcuggaagccgaucuccaaccagagcugggaccagaaguucacccuggagcucgaccggucccgcgagcuggagaucagcguguacuggcgggacuggcgcucccugugcgccgugaaguuccugcggcucgaggacuuccuggacaaccagcgccacgggaugugccuguaccucgagccccagggcacccuguucgccgaggucaccuucuucaaccccgugaucgagcggcgccccaagcugcagcggcagaagaagaucuucagcaagcagcaggggaagacguuccuccgcgcgccgcagaugaacaucaacaucgccaccuggggccggcugguccgccgggccauccccaccgugaaccacuccggcaccuucagcccccaggcccccgugccgacgaccguccccgugguggacguccgcaucccccagcuggcgcccccggccuccgacagcaccgugaccaagcucgacuucgaccuggagcccgagcccccgcccgccccgccccgggccuccagccugggggagaucgacgaguccagcgagcuccgcgugcuggacauccccggccaggacuccgagacggucuucgacauccagaacgaccggaacagcauccugcccaagucccagagcgaguacaagcccgacacgccccagagcgggcucgaguacuccggcauccaggagcuggaggaccgccggagccagcagcgcuuccaguucaaccugcaggacuuccgcugcugcgccgugcucgggcggggccacuucggcaaggugcugcuggcggaguacaagaacaccaacgagauguucgccaucaaggcccucaagaagggggacaucgucgcccgcgacgagguggacucccugaugugcgagaagcggaucuucgagaccgugaacagcguccgccacccguuccuggugaaccucuucgccugcuuccagaccaaggagcacgugugcuucgucauggaguacgcggccggcggggaccugaugaugcacauccacaccgacguguucuccgagccccgggccguguucuacgccgccugcgucgugcugggccuccaguaccugcacgagcacaagaucguguaccgcgaccugaagcucgacaaccugcugcucgacaccgagggguucgucaagaucgcggacuucggccugugcaaggagggcaugggguacggcgaccggaccagcaccuucugcgggacgcccgaguuccuggcccccgaggugcucaccgagaccuccuacacccgcgccguggacugguggggccuggggguccugaucuacgagaugcucgugggcgagagcccguuccccggcgacgacgaggaggagguguucgacuccaucgucaacgacgaggugcgguacccccgcuuccugagcacggaggccaucuccaucaugcggcgccugcuccggcgcaaccccgagcggcgccugggggccagcgagaaggacgcggaggacgugaagaagcacccguucuuccggcugaucgacugguccgcccucauggacaagaaggucaagccgcccuucauccccaccauccgcggccgggaggacgugagcaacuucgacgacgaguucaccuccgaggcccccauccugaccccgccccgcgagccccggauccugagcgaggaggagcaggagauguuccgcgacuucgacuacaucgccgacuggugcuga

SEQ ID NO: 9266 - RNA, 2955 nt, Artificial Sequence
  derived and/or modified sequence opt2 from PKN2__Homo_sapiens__AAB33346
auggccuccaaccccgagcgcggcgagauccuccucaccgagcuccagggcgacucccgcucccuccccuucuccgagaacgucuccgccguccagaagcucgacuucuccgacaccaugguccagcagaagcucgacgacaucaaggaccgcaucaagcgcgagauccgcaaggagcucaagaucaaggagggcgccgagaaccuccgcaaggucaccaccgacaagaagucccucgccuacgucgacaacauccucaagaaguccaacaagaagcucgaggagcuccaccacaagcuccaggagcucaacgcccacaucgucgucuccgaccccgaggacaucaccgacugcccccgcacccccgacacccccaacaacgacccccgcugcuccaccuccaacaaccgccucaaggcccuccagaagcagcucgacaucgagcucaaggucaagcagggcgccgagaacaugauccagauguacuccaacggcuccuccaaggaccgcaagcuccacggcaccgcccagcagcuccuccaggacuccaagaccaagaucgaggucauccgcaugcagauccuccaggccguccagaccaacgagcucgccuucgacaacgccaagcccgucaucuccccccucgagcuccgcauggaggagcuccgccaccacuuccgcaucgaguucgccgucgccgagggcgccaagaacgucaugaagcuccucggcuccggcaaggucaccgaccgcaaggcccucuccgaggcccaggcccgcuucaacgaguccucccagaagcucgaccuccucaaguacucccucgagcagcgccucaacgagguccccaagaaccaccccaagucccgcaucaucaucgaggagcucucccucgucgccgccucccccacccucuccccccgccaguccaugaucuccacccagaaccaguacuccacccucuccaagcccgccgcccucaccggcacccucgagguccgccucaugggcugccaggacauccucgagaacguccccggccgcuccaaggccaccuccgucgcccuccccggcuggucccccuccgagacccgcuccuccuucaugucccgcaccuccaaguccaaguccggcuccucccgcaaccuccucaagaccgacgaccucuccaacgacgucugcgccguccucaagcucgacaacaccgucgucggccagaccuccuggaagcccaucuccaaccaguccugggaccagaaguucacccucgagcucgaccgcucccgcgagcucgagaucuccgucuacuggcgcgacuggcgcucccucugcgccgucaaguuccuccgccucgaggacuuccucgacaaccagcgccacggcaugugccucuaccucgagccccagggcacccucuucgccgaggucaccuucuucaaccccgucaucgagcgccgccccaagcuccagcgccagaagaagaucuucuccaagcagcagggcaagaccuuccuccgcgccccccagaugaacaucaacaucgccaccuggggccgccucguccgccgcgccauccccaccgucaaccacuccggcaccuucuccccccaggcccccguccccaccaccguccccgucgucgacguccgcaucccccagcucgccccccccgccuccgacuccaccgucaccaagcucgacuucgaccucgagcccgagcccccccccgcccccccccgcgccuccucccucggcgagaucgacgaguccuccgagcuccgcguccucgacauccccggccaggacuccgagaccgucuucgacauccagaacgaccgcaacuccauccuccccaagucccaguccgaguacaagcccgacaccccccaguccggccucgaguacuccggcauccaggagcucgaggaccgccgcucccagcagcgcuuccaguucaaccuccaggacuuccgcugcugcgccguccucggccgcggccacuucggcaagguccuccucgccgaguacaagaacaccaacgagauguucgccaucaaggcccucaagaagggcgacaucgucgcccgcgacgaggucgacucccucaugugcgagaagcgcaucuucgagaccgucaacuccguccgccaccccuuccucgucaaccucuucgccugcuuccagaccaaggagcacgucugcuucgucauggaguacgccgccggcggcgaccucaugaugcacauccacaccgacgucuucuccgagccccgcgccgucuucuacgccgccugcgucguccucggccuccaguaccuccacgagcacaagaucgucuaccgcgaccucaagcucgacaaccuccuccucgacaccgagggcuucgucaagaucgccgacuucggccucugcaaggagggcaugggcuacggcgaccgcaccuccaccuucugcggcacccccgaguuccucgcccccgagguccucaccgagaccuccuacacccgcgccgucgacugguggggccucggcguccucaucuacgagaugcucgucggcgagucccccuuccccggcgacgacgaggaggaggucuucgacuccaucgucaacgacgagguccgcuacccccgcuuccucuccaccgaggccaucuccaucaugcgccgccuccuccgccgcaaccccgagcgccgccucggcgccuccgagaaggacgccgaggacgucaagaagcaccccuucuuccgccucaucgacugguccgcccucauggacaagaaggucaagccccccuucauccccaccauccgcggccgcgaggacgucuccaacuucgacgacgaguucaccuccgaggcccccauccucacccccccccgcgagccccgcauccucuccgaggaggagcaggagauguuccgcgacuucgacuacaucgccgacuggugcuga

SEQ ID NO: 9267 - RNA, 2955 nt, Artificial Sequence
  derived and/or modified sequence opt3 from PKN2__Homo_sapiens__AAB33346
auggccagcaaccccgagagaggcgaaauccugcucaccgagcuucagggggacuccaggucucugccuuucucagaaaaugugagugcuguccaaaaguuggauuuuagcgacacaaugguucagcagaaauuagaugacauuaaggaucggauaaaacgcgagauccgaaaggaacugaaaauuaaggagggagcagagaaccuacguaaggugacuacggacaaaaagucccucgccuacguagauaauauccugaaaaagucuaacaaaaagcuggaggaacuucaccauaaguugcaggaacucaaugcgcacauuguggucucggacccagaggauaucaccgacugcccgagaacacccgauacuccuaacaaugacccaagguguucaaccagcaacaaucggcugaaagcucugcaaaagcagcucgauauagaguuaaaagugaagcagggugccgaaaacaugauccagauguauaguaauggcuccucuaaagaccgcaagcugcaugggacagcacaacagcuuuugcaggacagcaaaaccaagauugagguuaucagaaugcagauucugcaagccgugcagacuaacgaacuagcuuucgauaaugcaaagcccgucaucuccccucucgagcugaggauggaggaacuucggcaccauuuucgcauagaguucgccguggcugaaggagccaaaaacguaaugaagcuguugggcucagguaaaguuacagaccgaaaggcgcucagugaggcacaggccagauuuaaugaaagcucucaaaaacuggauuuacugaaguacucccucgagcagaggcuuaacgaagugccaaagaaccaccccaaaucacggauuaucauugaggagcugagcuuggucgcugccaguccuacccuaucuccacgucaguccaugaucagcacgcagaaucaauauucgacucugucuaagccggcagcucucaccgggacacuggaagugcgccuuaugggaugccaggacauccuggagaacgugcccggcagauccaaagccacuucagucgcguugccuggcuggaguccaagcgaaaccagguccucuuucaugagccggacaucaaagaguaaauccgggagcucucgaaaucuccugaagaccgaugacuuaucaaacgauguuugugccgugcugaagcuagacaauacgguagugggacagacuuccuggaaacccauuagcaaccaguccugggaucaaaaguuuacacucgagcuggaccgcucuagagaacuugagauaucggucuacuggagggauuggcggagcuugugcgcagugaaauuccugcgccucgaggacuuucuggacaaucagagacacgguaugugucuuuaucuggaaccucagggcaccuuguucgcugagguuacauuuuucaacccagugaucgaaaggcgucccaagcuccagcggcagaaaaagauuuuuaguaagcaacaggggaaaacuuuccugcgagccccgcagaugaauaucaacauagcuaccuggggaagauuagucaggcgcgccauuccuacggugaaucauucaggcaccuucaguccccaagcaccaguaccuacaacuguucccguggucgaugugcggaucccacagcuggcucccccugccucugacagcaccgucacaaagcuagauuuugaccucgagccagagccgcccccugcgccacccagagcauccucacugggugaaaucgaugagagcucugaacuuaggguguuggacauuccugggcaggauuccgagacuguuuucgacauccaaaacgaucgcaauaguauucugccaaaaagccagucugaauacaagcccgacaccccgcaguccggacucgaguauucaggcauacaggagcuggaagaucgacggagucaacagcguuuucaguucaacuuacaggacuuuagaugcugugccgugcugggcagggggcacuucggaaaaguacuuuuggcugaguacaagaauacaaacgaaauguuugccaucaaagcacucaagaagggugauauugucgcccgcgacgagguggacagccugaugugcgaaaaacggaucuucgagaccguuaacucggugagacauccuuuucuagucaaucuguucgcuuguuuucaaacuaaggagcacgugugcuucguaauggaauacgccgcaggcggggaucucaugaugcacauccauacggacguguuuuccgagccaagggcgguuuucuaugcugccugugucgugcugggacuucaguacuugcacgaacauaaaauuguguaucgagaucugaaguuagacaaccuccugcuugauacagagggcuucgucaaaauagcagacuuuggucugugcaaggaagggaugggcuacggagaucgcaccucuacuuucugcggcacccccgaguuuuuggccccugagguucucacagaaaccagcuauacucgggcuguggacuggugggggcugggagugcuaaucuacgagaugcugguaggugaaucacccuucccaggcgaugacgaggaggaagucuuugauaguauugugaaugacgagguuagauauccuagguuccucuccacagaagccaucucuauuaugcgucgccugcuucggagaaaccccgagaggcgauugggggcaagcgaaaaggaugcugaggacgugaaaaagcacccauuuuuccggcugaucgacugguccgccuuaauggauaaaaaggucaaaccgccuuuuauacccacgauccgcggaagagaggacgugucaaauuucgaugacgaauuuaccagcgaggcgccaauucucacucccccuagggaaccacggauccugagugaggaggaacaggagauguuccgagauuuugacuacauugccgauugguguuga

SEQ ID NO: 9268 - RNA, 2955 nt, Artificial Sequence
  derived and/or modified sequence opt4 from PKN2__Homo_sapiens__AAB33346
auggccagcaaccccgagagaggcgagauccugcugaccgagcugcagggcgacagcagaagccugcccuucagcgagaacgugagcgccgugcagaagcuggacuucagcgacaccauggugcagcagaagcuggacgacaucaaggacagaaucaagagagagaucagaaaggagcugaagaucaaggagggcgccgagaaccugagaaaggugaccaccgacaagaagagccuggccuacguggacaacauccugaagaagagcaacaagaagcuggaggagcugcaccacaagcugcaggagcugaacgcccacaucguggugagcgaccccgaggacaucaccgacugccccagaacccccgacacccccaacaacgaccccagaugcagcaccagcaacaacagacugaaggcccugcagaagcagcuggacaucgagcugaaggugaagcagggcgccgagaacaugauccagauguacagcaacggcagcagcaaggacagaaagcugcacggcaccgcccagcagcugcugcaggacagcaagaccaagaucgaggugaucagaaugcagauccugcaggccgugcagaccaacgagcuggccuucgacaacgccaagcccgugaucagcccccuggagcugagaauggaggagcugagacaccacuucagaaucgaguucgccguggccgagggcgccaagaacgugaugaagcugcugggcagcggcaaggugaccgacagaaaggcccugagcgaggcccaggccagauucaacgagagcagccagaagcuggaccugcugaaguacagccuggagcagagacugaacgaggugcccaagaaccaccccaagagcagaaucaucaucgaggagcugagccugguggccgccagccccacccugagccccagacagagcaugaucagcacccagaaccaguacagcacccugagcaagcccgccgcccugaccggcacccuggaggugagacugaugggcugccaggacauccuggagaacgugcccggcagaagcaaggccaccagcguggcccugcccggcuggagccccagcgagaccagaagcagcuucaugagcagaaccagcaagagcaagagcggcagcagcagaaaccugcugaagaccgacgaccugagcaacgacgugugcgccgugcugaagcuggacaacaccguggugggccagaccagcuggaagcccaucagcaaccagagcugggaccagaaguucacccuggagcuggacagaagcagagagcuggagaucagcguguacuggagagacuggagaagccugugcgccgugaaguuccugagacuggaggacuuccuggacaaccagagacacggcaugugccuguaccuggagccccagggcacccuguucgccgaggugaccuucuucaaccccgugaucgagagaagacccaagcugcagagacagaagaagaucuucagcaagcagcagggcaagaccuuccugagagccccccagaugaacaucaacaucgccaccuggggcagacuggugagaagagccauccccaccgugaaccacagcggcaccuucagcccccaggcccccgugcccaccaccgugcccgugguggacgugagaaucccccagcuggccccccccgccagcgacagcaccgugaccaagcuggacuucgaccuggagcccgagcccccccccgccccccccagagccagcagccugggcgagaucgacgagagcagcgagcugagagugcuggacauccccggccaggacagcgagaccguguucgacauccagaacgacagaaacagcauccugcccaagagccagagcgaguacaagcccgacaccccccagagcggccuggaguacagcggcauccaggagcuggaggacagaagaagccagcagagauuccaguucaaccugcaggacuucagaugcugcgccgugcugggcagaggccacuucggcaaggugcugcuggccgaguacaagaacaccaacgagauguucgccaucaaggcccugaagaagggcgacaucguggccagagacgagguggacagccugaugugcgagaagagaaucuucgagaccgugaacagcgugagacaccccuuccuggugaaccuguucgccugcuuccagaccaaggagcacgugugcuucgugauggaguacgccgccggcggcgaccugaugaugcacauccacaccgacguguucagcgagcccagagccguguucuacgccgccugcguggugcugggccugcaguaccugcacgagcacaagaucguguacagagaccugaagcuggacaaccugcugcuggacaccgagggcuucgugaagaucgccgacuucggccugugcaaggagggcaugggcuacggcgacagaaccagcaccuucugcggcacccccgaguuccuggcccccgaggugcugaccgagaccagcuacaccagagccguggacugguggggccugggcgugcugaucuacgagaugcuggugggcgagagccccuuccccggcgacgacgaggaggagguguucgacagcaucgugaacgacgaggugagauaccccagauuccugagcaccgaggccaucagcaucaugagaagacugcugagaagaaaccccgagagaagacugggcgccagcgagaaggacgccgaggacgugaagaagcaccccuucuucagacugaucgacuggagcgcccugauggacaagaaggugaagccccccuucauccccaccaucagaggcagagaggacgugagcaacuucgacgacgaguucaccagcgaggcccccauccugaccccccccagagagcccagaauccugagcgaggaggagcaggagauguucagagacuucgacuacaucgccgacuggugcuga

SEQ ID NO: 9269 - RNA, 2955 nt, Artificial Sequence
  derived and/or modified sequence opt5 from PKN2__Homo_sapiens__AAB33346
auggccagcaaccccgagagaggcgaaauccugcucaccgagcugcagggggacucccggucucuuccuuucagcgaaaauguguccgcuguccaaaagcuggauuuuucugacacaaugguucagcagaaacucgaugacauuaaggaucgcaucaaaagagagauucggaaggaacugaaaaucaaggagggagccgagaaccuucgcaaggugacgaccgacaaaaagagccuggcguacguggauaauauucucaaaaaguccaacaaaaagcuggaggaacugcaccauaagcuccaggaacugaaugcucacaucgucgugucugacccggaggauaucacagacugccccagaaccccugauacacccaacaaugacccucgguguagcaccuccaacaaucgccuuaaagcccugcaaaagcagcucgauauugagcugaaaguuaagcagggcgccgaaaacaugauccagauguauagcaaugggucuuccaaagacagaaaacuucauggaacagcucaacagcugcuccaggacagcaaaaccaagauugaggugauccggaugcagauucugcaagccguccagacgaacgaacuggcuuucgauaaugccaagcccgugaucucuccucucgagcugcgcauggaggaacuuagacaccauuuucggauugaguucgcgguugccgaaggcgcuaaaaacgugaugaagcugcucggguccggaaaagucaccgaccgcaaggcccugagcgaggcucaggccagauuuaaugaaucuucccaaaaacuugaucugcucaaguacagccuggagcagcggcugaacgaagugccgaagaaccaccccaaaucccgcaucaucauugaggagcucucucugguggcggccagcccuacacuuucccccagacagagcaugaucucuacccagaaucaauauuccacacugagcaagccugcugcccucaccggcacgcuggaaguccggcuuaugggcugccaggacauucuggagaacguucccgggagaucuaaagcuacaagcguggcccucccgggaugguccccuucugaaacccgcagcuccuucaugagccggacaucuaaguccaaaagcgggucuuccagaaaucugcugaagaccgaugaccucagcaacgaugugugugccguccugaaacuugacaauaccgugguuggccagacauccuggaagcccaucucuaaccagagcugggaucaaaaguuuacgcuggagcucgaccgcucccgggaacuggagauuucuguguacuggagagauuggcgcagccugugcgcugucaaauuccuucggcucgaggacuuucuggacaaucagagacacggaaugugucuguaucucgaaccucagggcacccuguucgcggaggugacauuuuucaaccccguuaucgaacgccggcccaaacuucagagacaaaagaagaucuuuuccaagcagcaggggaagaccuuccugcgcgccccucagaugaauauuaacaucgcuacauggggacggcucgugagacgggccauuccgaccgucaaucauagcggcacguucucuccccaagccccugugcccacaaccgucccugugguugaugugcgcaucccccagcuggcuccgccugccuccgacagcaccgucacaaagcuggauuuugaccuugagcccgagccucccccugcgcccccgagagcuucuucccucggcgaaauugaugagagcucugaacugcgggugcuggacaucccugggcaggauagcgagaccguuuucgacauccaaaacgauagaaauuccauucuccccaaaagccagucugaauacaagcccgacacaccucaguccggacuggaguauagcggcauccaggagcuugaagaucgccggucccaacagagauuucaguucaaccugcaggacuuucgcugcugugccgugcucgggagaggacacuucggcaaaguccugcuggccgaguacaagaauacgaacgaaauguuugcuauuaaagcccuuaagaagggggauaucguggcucgggacgagguggacucucucaugugcgaaaaacgcauuuucgagaccguuaacagcgucagacauccguuucuggugaaucuguucgccuguuuucaaacaaaggagcacgugugcuucgucauggaauacgcggccggaggcgaucucaugaugcacauccauaccgacguguuuuccgagccccgggcuguuuucuaugccgcuugugugguccugggccuucaguaccugcacgaacauaaaauuguguaucgcgaucucaagcuggacaaccugcuucucgauacagagggguucguuaaaaucgccgacuuuggacugugcaaggaaggcaugggguacggagauagaaccucuacguucugcggcaccccugaguuucuggcgcccgaggugcucacagaaaccagcuauacacgggccgucgacuggugggggcugggcgugcuuaucuacgagaugcugguuggagaauccccuuuccccggcgaugacgaggaggaaguguuugauucuauugucaaugacgaggugcgcuauccuagauuccucagcaccgaagcuaucuccauuaugcggcgccugcugagacggaaccccgagagacgccuuggggccagcgaaaaggaugcugaggacgugaaaaagcacccguuuuuccggcugaucgacuggucugcccucauggauaaaaaggucaaaccucccuuuauuccuacgaucagaggacgcgaggacguuuccaauuucgaugacgaauuuacaagcgaggcccccauccugaccccgccucgggaaccccgcauucucucugaggaggaacaggagauguucagagauuuugacuacaucgcugauugguguuga

SEQ ID NO: 9270 - protein, 889 aa, Artificial Sequence
  PKN3__Homo_sapiens__Q6P5Z2
MEEGAPRQPGPSQWPPEDEKEVIRRAIQKELKIKEGVENLRRVATDRRHLGHVQQLLRSSNRRLEQLHGELRELHARILLPGPGPGPAEPVASGPRPWAEQLRARHLEALRRQLHVELKVKQGAENMTHTCASGTPKERKLLAAAQQMLRDSQLKVALLRMKISSLEASGSPEPGPELLAEELQHRLHVEAAVAEGAKNVVKLLSSRRTQDRKALAEAQAQLQESSQKLDLLRLALEQLLEQLPPAHPLRSRVTRELRAAVPGYPQPSGTPVKPTALTGTLQVRLLGCEQLLTAVPGRSPAAALASSPSEGWLRTKAKHQRGRGELASEVLAVLKVDNRVVGQTGWGQVAEQSWDQTFVIPLERARELEIGVHWRDWRQLCGVAFLRLEDFLDNACHQLSLSLVPQGLLFAQVTFCDPVIERRPRLQRQERIFSKRRGQDFLRASQMNLGMAAWGRLVMNLLPPCSSPSTISPPKGCPRTPTTLREASDPATPSNFLPKKTPLGEEMTPPPKPPRLYLPQEPTSEETPRTKRPHMEPRTRRGPSPPASPTRKPPRLQDFRCLAVLGRGHFGKVLLVQFKGTGKYYAIKALKKQEVLSRDEIESLYCEKRILEAVGCTGHPFLLSLLACFQTSSHACFVTEFVPGGDLMMQIHEDVFPEPQARFYVACVVLGLQFLHEKKIIYRDLKLDNLLLDAQGFLKIADFGLCKEGIGFGDRTSTFCGTPEFLAPEVLTQEAYTRAVDWWGLGVLLYEMLVGECPFPGDTEEEVFDCIVNMDAPYPGFLSVQGLEFIQKLLQKCPEKRLGAGEQDAEEIKVQPFFRTTNWQALLARTIQPPFVPTLCGPADLRYFEGEFTGLPPALTPPAPHSLLTARQQAAFRDFDFVSERFLEP

SEQ ID NO: 9271 - RNA, 2670 nt, Artificial Sequence
  PKN3__Homo_sapiens__AAH62558
auggaggagggggcgccgcggcagccugggccgagccaguggcccccagaggaugagaaggaggugauccgccgggccauccagaaagagcugaagaucaaggaggggguggagaaccugcggcgcguggccacagaccgccgccacuugggccaugugcagcagcugcugcgguccuccaaccgccgccuggagcagcugcauggcgagcugcgggagcugcacgcccgaauccugcugcccggcccugggccuggcccagcugagccuguggccucaggaccccggccgugggcagagcagcucagggcucggcaccuagaggcucuccggaggcagcugcauguggagcugaaggugaagcagggggcugagaacaugacccacacgugcgccaguggcacccccaaggagaggaagcuccuggcagcugcccagcagaugcugcgggacagccagcugaagguggcccugcugcggaugaagaucagcagccuggaggccaguggguccccggagccagggccugagcugcuggcggaggagcuacagcaucgacugcacguugaggcagcuguggcugagggcgccaagaacguggugaaacugcuuaguagccggagaacacaggaccgcaaggcacuggcugaggcccaggcccagcuacaggaguccucucagaaacuggaccuccugcgccuggccuuggagcagcugcuggagcaacugccuccugcccacccuuugcgcagcagagugacccgagaguugcgggcugcggugccuggauacccccagccuucagggacaccugugaagcccaccgcccuaacagggacacugcagguccgccuccugggcugugaacaguugcugacagccgugccugggcgcuccccagcggccgcacuggccagcagccccuccgagggcuggcuucggaccaaggccaagcaccagcguggccgaggcgagcuugccagcgaggugcuggcugugcuaaagguggacaaccguguuguggggcagacgggcugggggcagguggccgaacaguccugggaccagaccuuugucaucccacuggagcgagcccgugagcuggagauugggguacacuggcgggacuggcggcagcuauguggcguggccuuccugagacuugaggacuuccuggacaaugccugucaccaacugucccucagccugguaccgcagggacugcuuuuugcccaggugaccuucugcgauccugucauugagaggcggccccggcugcagaggcaggaacgcaucuucucuaaacgcagaggccaggacuuccugagggcuucgcagaugaaccucggcauggcggccugggggcgccucgucaugaaccugcugccccccugcagcuccccgagcacaaucagccccccuaaaggaugcccucggaccccaacaacacugcgagaggccucugacccugccacucccaguaauuuccugcccaagaagacccccuugggugaagagaugacacccccacccaagcccccacgccucuaccucccccaggagccaacauccgaggagacuccgcgcaccaaacguccccauauggagccuaggacucgacgugggccaucuccaccagccucccccaccaggaaacccccucggcuucaggacuuccgcugcuuagcugugcugggccggggacacuuugggaagguccuccugguccaguucaaggggacagggaaauacuacgccaucaaagcacugaagaagcaggaggugcucagccgggacgagauagagagccuguacugcgagaagcggauccuggaggcugugggcugcacagggcacccuuuccugcucucccuccuugccugcuuccagaccuccagccaugccugcuuugugacugaguuugugccugguggugaccucaugaugcagauccacgaggaugucuuccccgagccccaggcccgcuucuacguggcuuguguuguccuggggcugcaguucuuacacgagaagaagaucauuuacagggaccugaaguuggauaaccuucugcuggaugcccagggauuccugaagaucgcagacuuuggacucugcaaggaagggaucggcuucggggaccggacuagcaccuucuguggcaccccggaguuccuggcucccgaggugcugacccaggaggcauacacacgggcuguggacuggugggggcugggugugcugcucuacgagaugcuggugggugagugcccguucccaggggacacagaggaagagguguuugacugcaucgucaacauggacgcccccuaccccggcuuucugucggugcaagggcuugaguucauucagaagcuccuccagaagugcccggagaagcgccucggggcaggugagcaggaugccgaggagaucaagguccagccauucuucaggaccaccaacuggcaagcccugcucgcccgcaccauccagccccccuucgugccuacccuguguggcccugcggaccugcgcuacuuugagggcgaguucacagggcugccgccugcccugaccccaccugcaccccacagccuccucacugcccgccaacaggccgccuuccgggacuucgacuuugugucagagcgauuccuggaacccuga

SEQ ID NO: 9272 - RNA, 2670 nt, Artificial Sequence
  derived and/or modified sequence opt1 from PKN3__Homo_sapiens__AAH62558
auggaggagggcgcgccccgccagccggggcccagccaguggccgcccgaggacgagaaggaggugauccggcgcgccauccagaaggagcugaagaucaaggagggcgucgagaaccuccggcgcguggccaccgaccggcgccaccuggggcacgugcagcagcugcuccgguccagcaaccgccggcuggagcagcugcacggcgagcuccgcgagcugcacgcccggauccugcucccggggcccggccccggccccgccgagccggucgccuccgggccccgccccugggccgagcagcugcgggcgcgccaccuggaggcccuccggcgccagcugcacguggagcugaaggugaagcagggcgccgagaacaugacccacacgugcgccagcgggacccccaaggagcggaagcuccuggcggccgcccagcagaugcugcgcgacucccagcucaaggucgcccugcugcggaugaagaucagcucccucgaggccagcggcuccccggagcccgggcccgagcugcuggcggaggagcuccagcaccgccugcacguggaggccgccguggccgagggcgccaagaacgucgugaagcugcucagcucccggcgcacccaggaccgcaaggcgcuggccgaggcccaggcccagcugcaggagagcucccagaagcucgaccugcugcggcucgcccuggagcagcugcucgagcagcugcccccggcgcacccccugcgcagccgggugacccgcgagcuccgggccgccguccccggcuacccccagccguccgggacgcccgugaagcccaccgcccugaccggcacccuccaggugcgccuccuggggugcgagcagcugcucacggccguccccggccggagcccggcggccgcccuggccuccagccccuccgagggcuggcugcgcaccaaggcgaagcaccagcgggggcgcggcgagcucgccagcgaggugcuggccgugcugaaggucgacaaccgggugguggggcagaccggcugggggcaggucgccgagcagagcugggaccagaccuucgugaucccccuggagcgcgcccgggagcucgagaucggcgugcacuggcgcgacuggcggcagcugugcggcgucgcguuccugcgccucgaggacuuccuggacaacgccugccaccagcugucccucagccuggugccccaggggcuccucuucgcccaggucacguucugcgacccggugaucgagcggcgcccccggcugcagcgccaggagcgcaucuucuccaagcggcgcggccaggacuuccugcgggccagccagaugaaccucgggauggccgcguggggccgccuggugaugaaccugcugcccccgugcuccagccccuccaccaucagcccgcccaaggggugcccccggacccccaccacgcugcgcgaggccuccgaccccgccacccccagcaacuuccugccgaagaagacgccccucggcgaggagaugaccccgccgcccaagccgccccggcuguaccugccccaggagcccaccuccgaggagacgccccgcaccaagcggccccacauggagccccgcacccggcgcggccccagcccgcccgccucccccacccggaagccgccccgccuccaggacuuccggugccuggccguccuggggcgcggccacuucgggaaggugcuccuggugcaguucaagggcaccgggaaguacuacgcgaucaaggcccugaagaagcaggagguccucagccgggacgagaucgagucccuguacugcgagaagcgcauccuggaggccgugggcugcaccggccaccccuuccuccugagccugcucgccugcuuccagaccuccagccacgcgugcuucgugacggaguucguccccgggggcgaccugaugaugcagauccacgaggacguguuccccgagccccaggcccgguucuacguggccugcgucgugcuggggcuccaguuccugcacgagaagaagaucaucuaccgcgaccugaagcucgacaaccugcugcucgacgcccagggcuuccugaagaucgccgacuucggccugugcaaggaggggaucggcuucggggaccggaccuccaccuucugcggcacccccgaguuccucgcgcccgaggugcugacgcaggaggccuacacccgcgccgucgacuggugggggcugggcgugcuccuguacgagaugcuggugggcgagugccccuuccccggggacaccgaggaggaggucuucgacugcaucgugaacauggacgcccccuacccgggcuuccucagcgugcaggggcuggaguucauccagaagcugcuccagaagugccccgagaagcgccugggcgccggggagcaggacgcggaggagaucaagguccagcccuucuuccggaccacgaacuggcaggcccugcucgcccgcaccauccagcccccguucgugcccacccugugcggccccgccgaccugcgguacuucgagggcgaguucaccgggcugcccccggcccugaccccgcccgcgccccacagccugcucacggcccgccagcaggccgccuuccgggacuucgacuucguguccgagcgcuuccuggagcccuga

SEQ ID NO: 9273 - RNA, 2670 nt, Artificial Sequence
  derived and/or modified sequence opt2 from PKN3__Homo_sapiens__AAH62558
auggaggagggcgccccccgccagcccggccccucccaguggccccccgaggacgagaaggaggucauccgccgcgccauccagaaggagcucaagaucaaggagggcgucgagaaccuccgccgcgucgccaccgaccgccgccaccucggccacguccagcagcuccuccgcuccuccaaccgccgccucgagcagcuccacggcgagcuccgcgagcuccacgcccgcauccuccuccccggccccggccccggccccgccgagcccgucgccuccggcccccgccccugggccgagcagcuccgcgcccgccaccucgaggcccuccgccgccagcuccacgucgagcucaaggucaagcagggcgccgagaacaugacccacaccugcgccuccggcacccccaaggagcgcaagcuccucgccgccgcccagcagaugcuccgcgacucccagcucaaggucgcccuccuccgcaugaagaucuccucccucgaggccuccggcucccccgagcccggccccgagcuccucgccgaggagcuccagcaccgccuccacgucgaggccgccgucgccgagggcgccaagaacgucgucaagcuccucuccucccgccgcacccaggaccgcaaggcccucgccgaggcccaggcccagcuccaggaguccucccagaagcucgaccuccuccgccucgcccucgagcagcuccucgagcagcucccccccgcccacccccuccgcucccgcgucacccgcgagcuccgcgccgccguccccggcuacccccagcccuccggcacccccgucaagcccaccgcccucaccggcacccuccagguccgccuccucggcugcgagcagcuccucaccgccguccccggccgcucccccgccgccgcccucgccuccucccccuccgagggcuggcuccgcaccaaggccaagcaccagcgcggccgcggcgagcucgccuccgagguccucgccguccucaaggucgacaaccgcgucgucggccagaccggcuggggccaggucgccgagcaguccugggaccagaccuucgucaucccccucgagcgcgcccgcgagcucgagaucggcguccacuggcgcgacuggcgccagcucugcggcgucgccuuccuccgccucgaggacuuccucgacaacgccugccaccagcucucccucucccucgucccccagggccuccucuucgcccaggucaccuucugcgaccccgucaucgagcgccgcccccgccuccagcgccaggagcgcaucuucuccaagcgccgcggccaggacuuccuccgcgccucccagaugaaccucggcauggccgccuggggccgccucgucaugaaccuccucccccccugcuccucccccuccaccaucuccccccccaagggcugcccccgcacccccaccacccuccgcgaggccuccgaccccgccacccccuccaacuuccuccccaagaagaccccccucggcgaggagaugacccccccccccaagcccccccgccucuaccucccccaggagcccaccuccgaggagaccccccgcaccaagcgcccccacauggagccccgcacccgccgcggccccuccccccccgccucccccacccgcaagcccccccgccuccaggacuuccgcugccucgccguccucggccgcggccacuucggcaagguccuccucguccaguucaagggcaccggcaaguacuacgccaucaaggcccucaagaagcaggagguccucucccgcgacgagaucgagucccucuacugcgagaagcgcauccucgaggccgucggcugcaccggccaccccuuccuccucucccuccucgccugcuuccagaccuccucccacgccugcuucgucaccgaguucguccccggcggcgaccucaugaugcagauccacgaggacgucuuccccgagccccaggcccgcuucuacgucgccugcgucguccucggccuccaguuccuccacgagaagaagaucaucuaccgcgaccucaagcucgacaaccuccuccucgacgcccagggcuuccucaagaucgccgacuucggccucugcaaggagggcaucggcuucggcgaccgcaccuccaccuucugcggcacccccgaguuccucgcccccgagguccucacccaggaggccuacacccgcgccgucgacugguggggccucggcguccuccucuacgagaugcucgucggcgagugccccuuccccggcgacaccgaggaggaggucuucgacugcaucgucaacauggacgcccccuaccccggcuuccucuccguccagggccucgaguucauccagaagcuccuccagaagugccccgagaagcgccucggcgccggcgagcaggacgccgaggagaucaagguccagcccuucuuccgcaccaccaacuggcaggcccuccucgcccgcaccauccagccccccuucguccccacccucugcggccccgccgaccuccgcuacuucgagggcgaguucaccggccucccccccgcccucaccccccccgccccccacucccuccucaccgcccgccagcaggccgccuuccgcgacuucgacuucgucuccgagcgcuuccucgagcccuga

SEQ ID NO: 9274 - RNA, 2670 nt, Artificial Sequence
  derived and/or modified sequence opt3 from PKN3__Homo_sapiens__AAH62558
auggaggaaggcgcccccagacagccugggccaagccaauggccgcccgaggacgaaaaggaggugaucaggcgggcuauucagaaagaacugaagauaaaagagggagucgagaaccuccgccgaguugcaaccgaucguagacaccuuggucaugugcagcagcuguugagguccucuaaucggcgcuuagaacaacugcacggcgagcuaagagaacuccaugccaggauccugcuuccugggccaggacccggcccugcggagccaguagcuucagguccccggccuugggccgagcagcugcgcgcacgacacuuggaagcccucagaaggcagcugcauguggagcugaaggucaaacagggggcugaaaacaugacacacacuugcgcaaguggaacgccaaaggagcggaagcucuuagccgcugcccaacagaugcugcgugacagccagcuuaaaguggcguugcugcgcaugaagauuuccucucuagaagcaucgggcucaccggagcccggcccugagcuccuggccgaagaguugcagcacagacugcauguugaagcugccguggcagagggggcuaaaaaugucgugaaguugcucagcaguaggcggacccaagaucgaaaagcccuggcggaagcccaggcacaguuacaagaguccucucagaagcuggaccuccuucgccuggcuuuggagcagcuacuggaacagcucccacccgcccacccucugagaagcaggguaacacgggagcuucgcgcugccguuccaggauacccccaaccguccgguacuccugugaagcccaccgcacugacaggcaccuugcaggucagacuccuggggugugaacaguuacugacugccgugccaggaagguccccugcugcggcacuagccaguagccccucugagggcuggcuccguacaaaagcuaagcaucagcggggucgaggggaacuggccuccgaggugcuugcagucuugaaaguugauaacagagugguaggacaaaccggcuggggccagguggccgagcagucaugggaccagacguucgucaucccacuggaaagggcucgcgagcucgaaauuggggugcacuggcgggauuggagacaacugugcggaguugccuuucuuaggcuggaggacuucuuggauaaugcaugucaccagcucagccugaguuuagugccccagggucugcuauuugcgcaggucacuuucugcgacccugugaucgagcgccgaccacggcuccaacgucaggaaagaauauuuucuaagaggcgcggccaggauuuccugcgggcuucccaaaugaaccuugggauggccgcauggggaagauugguaaugaaucugcucccgcccuguagcucgccuucuaccaucuccccacccaaaggcugcccuaggacaccaacuacccugcgagaggccucagaccccgcuacaccgaguaacuuuuuaccuaagaaaaccccacugggugaagagaugacgcccccucccaagccaccucgccuuuauuugccccaggaaccaacuagcgaggagacaccgcggaccaagagaccucauauggaacccaggacucgucgcgggccaucacccccugccucuccaacacggaaacccccuagacuccaggauuucaggugucuggcaguucuaggccgaggacacuuuggcaaggugcugcucguccaguucaaagggaccggaaaguacuaugcuauuaaagcccugaagaagcaagaggugcuuagccgggacgaaaucgagucauuguacugcgaaaaacgcauucuggaggcggucgguuguacgggccauccguuuuuacucagucugcuugccugcuuccagaccuccagccacgcuuguuuugugacagaguucguuccagggggagaccugaugaugcagauccaugaagauguguuccccgagccucaggcaagauuuuauguagccugcgucguguugggccuccaauuccugcacgaaaagaaaauaauuuacagggaccuaaagcuggauaaucuccugcuugacgcucaggguuuucuuaaaaucgccgauuucgggcugugcaaggagggcauuggauuuggcgaccggacuucuaccuucugugggacaccagaauuuuuagcacccgagguucucacucaggaggcguauacccgagccguggauugguggggacuggguguccuucuguacgaaaugcuagugggcgagugcccuuucccgggggacacagaagaggagguauuugauuguaucgugaacauggacgcucccuacccaggauuccucucaguucagggccuggaauuuauccaaaaguugcugcagaaaugcccugagaagagauuaggugccggggaacaggaugcagaggaaauuaaaguccaacccuucuuucgcaccacuaauuggcaggcucuccuggccaggacgauacagccaccuuucgugcccacacuuuguggcccagcagaccugcguuauuucgagggagaguuuaccggcuugccgccugcccucacucccccagcuccccacagucugcuaaccgcgcggcagcaagccgcauucagagacuuugauuucgugagcgaaagguuucuggagccuuga

SEQ ID NO: 9275 - RNA, 2670 nt, Artificial Sequence
  derived and/or modified sequence opt4 from PKN3__Homo_sapiens__AAH62558
auggaggagggcgcccccagacagcccggccccagccaguggccccccgaggacgagaaggaggugaucagaagagccauccagaaggagcugaagaucaaggagggcguggagaaccugagaagaguggccaccgacagaagacaccugggccacgugcagcagcugcugagaagcagcaacagaagacuggagcagcugcacggcgagcugagagagcugcacgccagaauccugcugcccggccccggccccggccccgccgagcccguggccagcggccccagacccugggccgagcagcugagagccagacaccuggaggcccugagaagacagcugcacguggagcugaaggugaagcagggcgccgagaacaugacccacaccugcgccagcggcacccccaaggagagaaagcugcuggccgccgcccagcagaugcugagagacagccagcugaagguggcccugcugagaaugaagaucagcagccuggaggccagcggcagccccgagcccggccccgagcugcuggccgaggagcugcagcacagacugcacguggaggccgccguggccgagggcgccaagaacguggugaagcugcugagcagcagaagaacccaggacagaaaggcccuggccgaggcccaggcccagcugcaggagagcagccagaagcuggaccugcugagacuggcccuggagcagcugcuggagcagcugccccccgcccacccccugagaagcagagugaccagagagcugagagccgccgugcccggcuacccccagcccagcggcacccccgugaagcccaccgcccugaccggcacccugcaggugagacugcugggcugcgagcagcugcugaccgccgugcccggcagaagccccgccgccgcccuggccagcagccccagcgagggcuggcugagaaccaaggccaagcaccagagaggcagaggcgagcuggccagcgaggugcuggccgugcugaagguggacaacagaguggugggccagaccggcuggggccagguggccgagcagagcugggaccagaccuucgugaucccccuggagagagccagagagcuggagaucggcgugcacuggagagacuggagacagcugugcggcguggccuuccugagacuggaggacuuccuggacaacgccugccaccagcugagccugagccuggugccccagggccugcuguucgcccaggugaccuucugcgaccccgugaucgagagaagacccagacugcagagacaggagagaaucuucagcaagagaagaggccaggacuuccugagagccagccagaugaaccugggcauggccgccuggggcagacuggugaugaaccugcugccccccugcagcagccccagcaccaucagcccccccaagggcugccccagaacccccaccacccugagagaggccagcgaccccgccacccccagcaacuuccugcccaagaagaccccccugggcgaggagaugacccccccccccaagccccccagacuguaccugccccaggagcccaccagcgaggagacccccagaaccaagagaccccacauggagcccagaaccagaagaggccccagcccccccgccagccccaccagaaagccccccagacugcaggacuucagaugccuggccgugcugggcagaggccacuucggcaaggugcugcuggugcaguucaagggcaccggcaaguacuacgccaucaaggcccugaagaagcaggaggugcugagcagagacgagaucgagagccuguacugcgagaagagaauccuggaggccgugggcugcaccggccaccccuuccugcugagccugcuggccugcuuccagaccagcagccacgccugcuucgugaccgaguucgugcccggcggcgaccugaugaugcagauccacgaggacguguuccccgagccccaggccagauucuacguggccugcguggugcugggccugcaguuccugcacgagaagaagaucaucuacagagaccugaagcuggacaaccugcugcuggacgcccagggcuuccugaagaucgccgacuucggccugugcaaggagggcaucggcuucggcgacagaaccagcaccuucugcggcacccccgaguuccuggcccccgaggugcugacccaggaggccuacaccagagccguggacugguggggccugggcgugcugcuguacgagaugcuggugggcgagugccccuuccccggcgacaccgaggaggagguguucgacugcaucgugaacauggacgcccccuaccccggcuuccugagcgugcagggccuggaguucauccagaagcugcugcagaagugccccgagaagagacugggcgccggcgagcaggacgccgaggagaucaaggugcagcccuucuucagaaccaccaacuggcaggcccugcuggccagaaccauccagccccccuucgugcccacccugugcggccccgccgaccugagauacuucgagggcgaguucaccggccugccccccgcccugaccccccccgccccccacagccugcugaccgccagacagcaggccgccuucagagacuucgacuucgugagcgagagauuccuggagcccuga

SEQ ID NO: 9276 - RNA, 2670 nt, Artificial Sequence
  derived and/or modified sequence opt5 from PKN3__Homo_sapiens__AAH62558
auggaggaaggcgcccccagacagccugggccgagccaauggcccccugaggacgaaaaggaggugauccggcgcgcuauucagaaagaacugaagaucaaagagggagucgagaaccucagacggguugccaccgaucgcagacaccugggccaugugcagcagcuucugcgguccucuaaucgcagacucgaacaacugcacggggagcuucgggaacugcaugcgcgcauucuccugcccggaccuggccccgggccugcugagccgguggccagcggacccagaccuugggccgagcagcugcgggcucgccaccucgaagcccugagacggcagcuucaugucgagcugaaggugaaacagggcgcugaaaacaugacacacacgugcgccuccggcacccccaaggagcgcaagcuccuggcggccgcucaacagaugcuuagagacucucagcugaaaguugcccuccugcggaugaagaucagcucccuggaagccucugggagcccugagcccggaccggagcuccuggccgaggaacuucagcacagacugcauguggaagcggccgucgcugagggcgccaaaaaugugguuaagcuccuguccagccgccggacacaagauagaaaagcucuugccgaagcccaggcucagcugcaagagucuucccagaagcucgaccugcugcgccucgcgcuggagcagcuucuggaacagcucccucccgcccacccucugcggagcagagugacccgcgagcuucgggcugccguccccggguacccccaaccuucuggaacaccggugaagcccaccgcccugacaggcacccuccaggugagacugcuggggugugaacagcuccugacggcugucccuggacgcucccccgccgcggcucuugccagcucuccuuccgagggcuggcugcggaccaaagccaagcaucagagaggccgcggggaacucgcuagcgagguucuggccgugcugaaaguggauaaccgggucgugggacaaacaggcugggggcagguugcugagcaguccugggaccagaccuucgugauuccccuugaaagagcccgggagcucgaaaucggaguccacuggcgcgauuggagacaacugugcggcguggcguuucugcggcucgaggacuuccuggauaaugccugucaccagcuuucucugagccucguuccgcaggggcugcuguuugcucaggugacauucugcgacccugucaucgagagacgcccccggcuucaaagacaggaacgcaucuuuuccaagagacggggacaggauuuccuccgcgccagccaaaugaaccugggcauggcugccuggggcagacuggugaugaaucuccugccucccuguucuuccccuagcaccauuucucccccgaaagggugcccucggacgcccacaacccuucgcgaggcgagcgaccccgccacaccuuccaacuuucugccgaagaaaacaccccucggagaagagaugaccccucccccuaagcccccuagacuguaucugccccaggaaccgaccucugaggagacgccucggaccaagcgcccccauauggaaccuagaacacggcgcggccccagcccgccugcuucccccaccagaaaaccuccccggcuucaggauuucagaugucucgccguccuggggcgcggacacuuuggcaaggugcugcucguucaguucaaagggacaggcaaguacuaugcuauuaaagcccugaagaagcaagaggugcuuagccgggacgaaaucgagucucuguacugcgaaaaacgcauucucgaggccgucggauguaccggccaucccuuucugcugucccuucucgcuugcuuccagacgagcucucacgcguguuuugugacagaguucguuccugggggagaccugaugaugcagauccaugaagauguguucccggagccccaggccagauuuuaugucgcuugcguggugcugggccuccaauuccugcacgaaaagaaaauuaucuaccgggaccuuaagcuggauaaucuccugcuggacgcccagggguuucuuaaaaucgccgauuucggacugugcaaggagggcauuggguuuggcgacagaaccuccaccuucuguggaacaccugaauuucucgcucccgagguucugacccaggaggccuauacacgcgcggucgauugguggggccucggggugcugcuuuacgaaaugcuggugggagagugcccuuuccccggcgacacggaagaggaggucuuugauuguaucgugaacauggacgcuccuuacccgggguuccucagcguucagggacuggaauuuauucaaaagcugcuucagaaaugccccgagaagcggcugggcgccggggaacaggaugccgaggaaaucaaagugcaaccuuucuuuagaaccacaaauuggcaggcucuccuggcccgcaccauucagcccccuuucguccccacacucuguggcccggcggaccugcgguauuucgagggagaguuuaccggccuuccucccgcucugacgcccccugcuccccacucccuccugaccgccagacagcaagcugccuuccgggacuuugauuucgugucugaacgcuuucuggagccuuga

SEQ ID NO: 9277 - protein, 672 aa, Artificial Sequence
  PRKCA__Homo_sapiens__P17252
MADVFPGNDSTASQDVANRFARKGALRQKNVHEVKDHKFIARFFKQPTFCSHCTDFIWGFGKQGFQCQVCCFVVHKRCHEFVTFSCPGADKGPDTDDPRSKHKFKIHTYGSPTFCDHCGSLLYGLIHQGMKCDTCDMNVHKQCVINVPSLCGMDHTEKRGRIYLKAEVADEKLHVTVRDAKNLIPMDPNGLSDPYVKLKLIPDPKNESKQKTKTIRSTLNPQWNESFTFKLKPSDKDRRLSVEIWDWDRTTRNDFMGSLSFGVSELMKMPASGWYKLLNQEEGEYYNVPIPEGDEEGNMELRQKFEKAKLGPAGNKVISPSEDRKQPSNNLDRVKLTDFNFLMVLGKGSFGKVMLADRKGTEELYAIKILKKDVVIQDDDVECTMVEKRVLALLDKPPFLTQLHSCFQTVDRLYFVMEYVNGGDLMYHIQQVGKFKEPQAVFYAAEISIGLFFLHKRGIIYRDLKLDNVMLDSEGHIKIADFGMCKEHMMDGVTTRTFCGTPDYIAPEIIAYQPYGKSVDWWAYGVLLYEMLAGQPPFDGEDEDELFQSIMEHNVSYPKSLSKEAVSVCKGLMTKHPAKRLGCGPEGERDVREHAFFRRIDWEKLENREIQPPFKPKVCGKGAENFDKFFTRGQPVLTPPDQLVIANIDQSDFEGFSYVNPQFVHPILQSAV

SEQ ID NO: 9278 - RNA, 2019 nt, Artificial Sequence
  PRKCA__Homo_sapiens__CCDS11664.1
auggcugacguuuucccgggcaacgacuccacggcgucucaggacguggccaaccgcuucgcccgcaaaggggcgcugaggcagaagaacgugcacgaggugaaggaccacaaauucaucgcgcgcuucuucaagcagcccaccuucugcagccacugcaccgacuucaucuggggguuugggaaacaaggcuuccagugccaaguuugcuguuuugugguccacaagaggugccaugaauuuguuacuuuuucuuguccgggugcggauaagggacccgacacugaugaccccaggagcaagcacaaguucaaaauccacacuuacggaagccccaccuucugcgaucacugugggucacugcucuauggacuuauccaucaagggaugaaaugugacaccugcgauaugaacguucacaagcaaugcgucaucaauguccccagccucugcggaauggaucacacugagaagagggggcggauuuaccuaaaggcugagguugcugaugaaaagcuccaugucacaguacgagaugcaaaaaaucuaaucccuauggauccaaacgggcuuucagauccuuaugugaagcugaaacuuauuccugaucccaagaaugaaagcaagcaaaaaaccaaaaccauccgcuccacacuaaauccgcaguggaaugaguccuuuacauucaaauugaaaccuucagacaaagaccgacgacugucuguagaaaucugggacugggaucgaacaacaaggaaugacuucaugggaucccuuuccuuuggaguuucggagcugaugaagaugccggccaguggaugguacaaguugcuuaaccaagaagaaggugaguacuacaacguacccauuccggaaggggacgaggaaggaaacauggaacucaggcagaaauucgagaaagccaaacuuggcccugcuggcaacaaagucaucagucccucugaagacaggaaacaaccuuccaacaaccuugaccgagugaaacucacggacuucaauuuccucaugguguugggaaaggggaguuuuggaaaggugaugcuugccgacaggaagggcacagaagaacuguaugcaaucaaaauccugaagaaggauguggugauucaggaugaugacguggagugcaccaugguagaaaagcgagucuuggcccugcuugacaaacccccguucuugacgcagcugcacuccugcuuccagacaguggaucggcuguacuucgucauggaauaugucaacgguggggaccucauguaccacauucagcaaguaggaaaauuuaaggaaccacaagcaguauucuaugcggcagagauuuccaucggauuguucuuucuucauaaaagaggaaucauuuauagggaucugaaguuagauaacgucauguuggauucagaaggacauaucaaaauugcugacuuugggaugugcaaggaacacaugauggauggagucacgaccaggaccuucugugggacuccagauuauaucgccccagagauaaucgcuuaucagccguauggaaaaucuguggacuggugggccuauggcguccuguuguaugaaaugcuugccgggcagccuccauuugauggugaagaugaagacgagcuauuucagucuaucauggagcacaacguuuccuauccaaaauccuuguccaaggaggcuguuucugucugcaaaggacugaugaccaaacacccagccaagcggcugggcugugggccugagggggagagggacgugagagagcaugccuucuuccggaggaucgacugggaaaaacuggagaacagggagauccagccaccauucaagcccaaaguguguggcaaaggagcagagaacuuugacaaguucuucacacgaggacagcccgucuuaacaccaccugaucagcugguuauugcuaacauagaccagucugauuuugaaggguucucguaugucaacccccaguuugugcaccccaucuuacagagugcaguauga

SEQ ID NO: 9279 - RNA, 2019 nt, Artificial Sequence
  derived and/or modified sequence opt1 from PRKCA__Homo_sapiens__CCDS11664.1
auggccgacguguuccccggcaacgacagcaccgccucccaggacgucgcgaaccgcuucgcccggaagggggcccugcgccagaagaacgugcacgaggugaaggaccacaaguucaucgcccgguucuucaagcagccgaccuucugcagccacugcaccgacuucaucuggggcuucgggaagcagggcuuccagugccaggucugcugcuucguggugcacaagcgcugccacgaguucgucaccuucuccugccccggggccgacaagggccccgacaccgacgacccccggagcaagcacaaguucaagauccacaccuacggcuccccgacguucugcgaccacugcgggagccuccuguacggccugauccaccaggggaugaagugcgacacgugcgacaugaacgugcacaagcagugcgugaucaacguccccucccucugcggcauggaccacaccgagaagcgcgggcggaucuaccugaaggcggagguggccgacgagaagcugcacgugaccguccgcgacgccaagaaccucauccccauggaccccaacggccugagcgacccguacgugaagcugaagcucauccccgaccccaagaacgaguccaagcagaagaccaagaccauccggagcacccugaacccccaguggaacgaguccuucaccuucaagcugaagccgagcgacaaggaccgccggcucuccguggagaucugggacugggaccgcacgacccggaacgacuucaugggcagccuguccuucggggucagcgagcugaugaagaugcccgccuccggcugguacaagcuccugaaccaggaggagggggaguacuacaacgugcccauccccgagggcgacgaggagggcaacauggagcugcgccagaaguucgagaaggcgaagcucgggccggccggcaacaaggugaucagccccuccgaggaccggaagcagcccagcaacaaccuggaccgcgucaagcugaccgacuucaacuuccucauggugcuggggaagggcagcuucgggaaggugaugcuggccgaccggaagggcaccgaggagcucuacgccaucaagauccugaagaaggacgucgugauccaggacgacgacguggagugcacgauggucgagaagcgcgugcuggcccuccuggacaagcccccguuccugacccagcuccacuccugcuuccagaccgucgaccggcuguacuucgugauggaguacgugaacggcggggaccugauguaccacauccagcaggucggcaaguucaaggagccccaggcgguguucuacgccgccgagaucagcaucggccucuucuuccugcacaagcgcgggaucaucuaccgggaccugaagcucgacaacgugaugcuggacuccgaggggcacaucaagaucgccgacuucggcaugugcaaggagcacaugauggacggcgucaccacgcgcaccuucugcgggacccccgacuacaucgcccccgagaucaucgcguaccagccguacggcaagagcguggacuggugggccuacggggugcugcucuacgagaugcuggccggccagccgcccuucgacggggaggacgaggacgagcuguuccaguccaucauggagcacaacgucagcuaccccaagucccucagcaaggaggccguguccgugugcaagggccugaugaccaagcaccccgccaagcgccugggcugcgggcccgagggcgagcgggacguccgcgagcacgcguucuuccggcgcaucgacugggagaagcucgagaaccgggagauccagcccccguucaagcccaaggugugcgggaagggcgccgagaacuucgacaaguucuucacgcgcggccagcccgugcugacgcccccggaccagcuggucaucgccaacaucgaccagagcgacuucgagggguucuccuacgugaacccccaguucgugcaccccauccuccagagcgccgucuga

SEQ ID NO: 9280 - RNA, 2019 nt, Artificial Sequence
  derived and/or modified sequence opt2 from PRKCA__Homo_sapiens__CCDS11664.1
auggccgacgucuuccccggcaacgacuccaccgccucccaggacgucgccaaccgcuucgcccgcaagggcgcccuccgccagaagaacguccacgaggucaaggaccacaaguucaucgcccgcuucuucaagcagcccaccuucugcucccacugcaccgacuucaucuggggcuucggcaagcagggcuuccagugccaggucugcugcuucgucguccacaagcgcugccacgaguucgucaccuucuccugccccggcgccgacaagggccccgacaccgacgacccccgcuccaagcacaaguucaagauccacaccuacggcucccccaccuucugcgaccacugcggcucccuccucuacggccucauccaccagggcaugaagugcgacaccugcgacaugaacguccacaagcagugcgucaucaacguccccucccucugcggcauggaccacaccgagaagcgcggccgcaucuaccucaaggccgaggucgccgacgagaagcuccacgucaccguccgcgacgccaagaaccucauccccauggaccccaacggccucuccgaccccuacgucaagcucaagcucauccccgaccccaagaacgaguccaagcagaagaccaagaccauccgcuccacccucaacccccaguggaacgaguccuucaccuucaagcucaagcccuccgacaaggaccgccgccucuccgucgagaucugggacugggaccgcaccacccgcaacgacuucaugggcucccucuccuucggcgucuccgagcucaugaagaugcccgccuccggcugguacaagcuccucaaccaggaggagggcgaguacuacaacguccccauccccgagggcgacgaggagggcaacauggagcuccgccagaaguucgagaaggccaagcucggccccgccggcaacaaggucaucucccccuccgaggaccgcaagcagcccuccaacaaccucgaccgcgucaagcucaccgacuucaacuuccucaugguccucggcaagggcuccuucggcaaggucaugcucgccgaccgcaagggcaccgaggagcucuacgccaucaagauccucaagaaggacgucgucauccaggacgacgacgucgagugcaccauggucgagaagcgcguccucgcccuccucgacaagccccccuuccucacccagcuccacuccugcuuccagaccgucgaccgccucuacuucgucauggaguacgucaacggcggcgaccucauguaccacauccagcaggucggcaaguucaaggagccccaggccgucuucuacgccgccgagaucuccaucggccucuucuuccuccacaagcgcggcaucaucuaccgcgaccucaagcucgacaacgucaugcucgacuccgagggccacaucaagaucgccgacuucggcaugugcaaggagcacaugauggacggcgucaccacccgcaccuucugcggcacccccgacuacaucgcccccgagaucaucgccuaccagcccuacggcaaguccgucgacuggugggccuacggcguccuccucuacgagaugcucgccggccagccccccuucgacggcgaggacgaggacgagcucuuccaguccaucauggagcacaacgucuccuaccccaagucccucuccaaggaggccgucuccgucugcaagggccucaugaccaagcaccccgccaagcgccucggcugcggccccgagggcgagcgcgacguccgcgagcacgccuucuuccgccgcaucgacugggagaagcucgagaaccgcgagauccagccccccuucaagcccaaggucugcggcaagggcgccgagaacuucgacaaguucuucacccgcggccagcccguccucaccccccccgaccagcucgucaucgccaacaucgaccaguccgacuucgagggcuucuccuacgucaacccccaguucguccaccccauccuccaguccgccgucuga

SEQ ID NO: 9281 - RNA, 2019 nt, Artificial Sequence
  derived and/or modified sequence opt3 from PRKCA__Homo_sapiens__CCDS11664.1
auggccgacguguuccccggcaacgauagcaccgcuucccaggacgucgcaaauagauuugccaggaagggggcgcugcggcaaaagaacguucacgaggugaaggaucauaaauucaucgcucgcuuuuucaagcagccuaccuuuugcucucacuguacugacuucauuuggggauuugguaaacagggcuuccagugccaaguauguugcuuugugguccauaagcgaugucacgaguucgugacguuuucaugcccaggggccgauaagggaccggacaccgaugacccccguaguaaacauaaguucaaaauacacacauacggcagcccuacuuuuugugaucacugcgguucccuccuuuaugggcugauccaucagggaaugaagugugauaccugcgacaugaauguucacaaacagugugugauuaacgucccaucuuugugcggcauggaccauacagaaaagagaggcaggaucuacuuaaaggcagaaguggccgaugagaaacugcacguaaccguucgggacgcuaagaaucuaauucccauggacccuaacgggcucucggauccauaugugaaacugaaacuuauccccgacccuaaaaaugaaucaaagcagaaaacuaagacaauacgcagcacccugaacccacaauggaaugagaguuucacguucaaguugaaaccguccgauaaggacagaaggcucucugucgagaucugggauugggaccggacuacccgcaacgauuuuaugggaagccuguccuucggugugucagaacugaugaaaaugcccgcaaguggcugguacaagcucuuaaaucaggaggaaggggaguauuacaacgugccuauuccagagggagacgaagagggcaauauggaacugcgacagaaauuugagaaggccaaacuuggucccgcugggaacaaggucaucagcccuucugaagauagaaagcagccauccaauaacuuggacaggguuaaacugacagauuucaacuuucuaauggugcucggaaagggcucauucggcaaaguaaugcuggccgaccggaaggggacugaggagcuuuaugcgauuaagauccugaaaaaggacguggucauacaagaugacgauguggaaugcaccaugguugagaaacguguguuggcacuccuggacaagcccccguuuuuaacacagcugcacagcuguuuccagaccgucgaucgccucuacuuugugauggaauacguaaauggaggugaccuuauguaucauauucaacagguuggcaaauucaaggagccucaggccguguuuuacgcugccgaaaucaguauugggcuguucuuuuugcacaagagaggaaucaucuauagggaucuaaaacuggacaacgucaugcucgauucugagggccauauuaagauagcagacuucgguaugugcaaagagcacaugauggauggggugacgacucggacauucuguggcacccccgacuacaucgcuccagaaauuaucgccuaucagccuuacggaaaguccgucgauuggugggcguauggcgugcugcuuuacgagaugcuggccgggcaacccccauuugacggagaagacgaggaugaauuguuccagagcauaauggagcauaauguuucguaccccaaaucucucuccaaggaggcagugucaguaugcaaaggucugaugacuaagcacccugcuaagcgauuaggcugugggccagaaggagagcgcgacgucagagaacacgccuuuuucaggcggauugauugggagaaacuggagaaccgcgaaauccagccgcccuuuaagccuaaagugugcggcaagggugcugagaauuucgacaaauuuuucacaagagggcagccaguucuaacacccccugaucaacucgugaucgccaacauugaccagagugauuuugaaggcuucagcuaugucaauccacaguuugugcaucccauccugcaguccgcaguauga

SEQ ID NO: 9282 - RNA, 2019 nt, Artificial Sequence
  derived and/or modified sequence opt4 from PRKCA__Homo_sapiens__CCDS11664.1
auggccgacguguuccccggcaacgacagcaccgccagccaggacguggccaacagauucgccagaaagggcgcccugagacagaagaacgugcacgaggugaaggaccacaaguucaucgccagauucuucaagcagcccaccuucugcagccacugcaccgacuucaucuggggcuucggcaagcagggcuuccagugccaggugugcugcuucguggugcacaagagaugccacgaguucgugaccuucagcugccccggcgccgacaagggccccgacaccgacgaccccagaagcaagcacaaguucaagauccacaccuacggcagccccaccuucugcgaccacugcggcagccugcuguacggccugauccaccagggcaugaagugcgacaccugcgacaugaacgugcacaagcagugcgugaucaacgugcccagccugugcggcauggaccacaccgagaagagaggcagaaucuaccugaaggccgagguggccgacgagaagcugcacgugaccgugagagacgccaagaaccugauccccauggaccccaacggccugagcgaccccuacgugaagcugaagcugauccccgaccccaagaacgagagcaagcagaagaccaagaccaucagaagcacccugaacccccaguggaacgagagcuucaccuucaagcugaagcccagcgacaaggacagaagacugagcguggagaucugggacugggacagaaccaccagaaacgacuucaugggcagccugagcuucggcgugagcgagcugaugaagaugcccgccagcggcugguacaagcugcugaaccaggaggagggcgaguacuacaacgugcccauccccgagggcgacgaggagggcaacauggagcugagacagaaguucgagaaggccaagcugggccccgccggcaacaaggugaucagccccagcgaggacagaaagcagcccagcaacaaccuggacagagugaagcugaccgacuucaacuuccugauggugcugggcaagggcagcuucggcaaggugaugcuggccgacagaaagggcaccgaggagcuguacgccaucaagauccugaagaaggacguggugauccaggacgacgacguggagugcaccaugguggagaagagagugcuggcccugcuggacaagccccccuuccugacccagcugcacagcugcuuccagaccguggacagacuguacuucgugauggaguacgugaacggcggcgaccugauguaccacauccagcaggugggcaaguucaaggagccccaggccguguucuacgccgccgagaucagcaucggccuguucuuccugcacaagagaggcaucaucuacagagaccugaagcuggacaacgugaugcuggacagcgagggccacaucaagaucgccgacuucggcaugugcaaggagcacaugauggacggcgugaccaccagaaccuucugcggcacccccgacuacaucgcccccgagaucaucgccuaccagcccuacggcaagagcguggacuggugggccuacggcgugcugcuguacgagaugcuggccggccagccccccuucgacggcgaggacgaggacgagcuguuccagagcaucauggagcacaacgugagcuaccccaagagccugagcaaggaggccgugagcgugugcaagggccugaugaccaagcaccccgccaagagacugggcugcggccccgagggcgagagagacgugagagagcacgccuucuucagaagaaucgacugggagaagcuggagaacagagagauccagccccccuucaagcccaaggugugcggcaagggcgccgagaacuucgacaaguucuucaccagaggccagcccgugcugaccccccccgaccagcuggugaucgccaacaucgaccagagcgacuucgagggcuucagcuacgugaacccccaguucgugcaccccauccugcagagcgccguguga

SEQ ID NO: 9283 - RNA, 2019 nt, Artificial Sequence
  derived and/or modified sequence opt5 from PRKCA__Homo_sapiens__CCDS11664.1
auggccgacguguuccccggcaacgauagcaccgcuucccaggacgucgccaauagauuugcgcggaagggggcucugcgccagaaaaacguucacgaggugaaggaucauaaauucaucgccagauuuuucaagcaaccuacauuuugcucucacuguacggacuucauuuggggauuuggcaaacagggguuccagugccaaguguguugcuuugucgugcauaagcggugucacgaguucguuaccuuuagcugcccgggagccgauaagggccccgacacagaugacccucgcuccaaacauaaguucaaaauccacaccuacgggucucccacauuuugugaucacugcggaagccuccuguauggccuuauucaucagggcaugaagugugauaccugcgacaugaaugugcacaaacagugugucaucaacgugccuucccugugcgggauggaccauacagaaaagagaggacggauuuaccucaaggcugaaguugccgaugagaaacugcacgugaccguccgcgacgcuaagaaucuuauccccauggacccuaacggccugucugauccguaugugaaacucaagcugauccccgacccuaaaaaugaaagcaagcagaaaacgaagaccauuagauccacacugaacccccaauggaaugagagcuucaccuucaagcucaaaccuucugauaaggaccggcgccuguccguggagaucugggauugggacagaacaacccggaacgauuuuauggggagccuuucuuucggagucuccgaacugaugaaaaugcccgccagcggcugguacaagcuccugaaucaggaggaaggggaguauuacaacguuccgauuccugagggagacgaagagggcaauauggaacuucgccagaaauuugagaaggcgaagcugggccccgccgggaacaaagugaucucuccuuccgaagauagaaagcagcccagcaauaaccucgaccgggugaaacugacggauuucaacuuucugaugguccucggaaagggcuccuucgggaaagugaugcuggcugaccgcaagggaacagaggagcuuuaugccauuaagauccugaaaaaggacguugugauucaagaugacgaugucgaaugcaccaugguggagaaaagaguucucgcucugcuugacaagcccccuuuucugacacagcuccacucuuguuuccagaccguggaucggcuguacuuugucauggaauacgugaauggcggggaccugauguaucauauccaacaggucggaaaauucaaggagccgcaggccguguuuuacgcggccgaaaucagcauuggccucuucuuucugcacaagagaggcaucauuuaucgcgaucuuaaacuggacaacguuaugcucgauuccgaggggcauaucaagauugcugacuucggaaugugcaaagagcacaugauggauggcgugaccacacggacguucugugggacccccgacuacaucgccccugaaaucauugcuuaucagcccuacggaaagagcgucgauuggugggccuauggcgugcugcuuuacgagaugcuggccgggcaaccucccuuugacggcgaagacgaggaugaacucuuccagucuaucauggagcauaauguuuccuacccgaaaagccugucuaaggaggcugugagcgucugcaaaggacugaugacaaagcacccugcgaagagacucggcugugggcccgaaggagagcgcgacgugcgggaacacgccuuuuucagacgcauugauugggagaaacuggagaaccgggaaauccagccucccuuuaagccuaaagugugcggcaagggggcugagaauuucgacaaauuuuucaccagaggacagcccguucuuacaccgccugaucaacuggucauugccaacaucgaccaguccgauuuugaaggcuucucuuaugugaauccccaguuugugcaucccauccuccagagcgccgucuga

SEQ ID NO: 9284 - protein, 878 aa, Artificial Sequence
  PRKD2__Homo_sapiens__NP_001073349.1
MATAPSYPAGLPGSPGPGSPPPPGGLELQSPPPLLPQIPAPGSGVSFHIQIGLTREFVLLPAASELAHVKQLACSIVDQKFPECGFYGLYDKILLFKHDPTSANLLQLVRSSGDIQEGDLVEVVLSASATFEDFQIRPHALTVHSYRAPAFCDHCGEMLFGLVRQGLKCDGCGLNYHKRCAFSIPNNCSGARKRRLSSTSLASGHSVRLGTSESLPCTAEELSRSTTELLPRRPPSSSSSSSASSYTGRPIELDKMLLSKVKVPHTFLIHSYTRPTVCQACKKLLKGLFRQGLQCKDCKFNCHKRCATRVPNDCLGEALINGDVPMEEATDFSEADKSALMDESEDSGVIPGSHSENALHASEEEEGEGGKAQSSLGYIPLMRVVQSVRHTTRKSSTTLREGWVVHYSNKDTLRKRHYWRLDCKCITLFQNNTTNRYYKEIPLSEILTVESAQNFSLVPPGTNPHCFEIVTANATYFVGEMPGGTPGGPSGQGAEAARGWETAIRQALMPVILQDAPSAPGHAPHRQASLSISVSNSQIQENVDIATVYQIFPDEVLGSGQFGVVYGGKHRKTGRDVAVKVIDKLRFPTKQESQLRNEVAILQSLRHPGIVNLECMFETPEKVFVVMEKLHGDMLEMILSSEKGRLPERLTKFLITQILVALRHLHFKNIVHCDLKPENVLLASADPFPQVKLCDFGFARIIGEKSFRRSVVGTPAYLAPEVLLNQGYNRSLDMWSVGVIMYVSLSGTFPFNEDEDINDQIQNAAFMYPASPWSHISAGAIDLINNLLQVKMRKRYSVDKSLSHPWLQEYQTWLDLRELEGKMGERYITHESDDARWEQFAAEHPLPGSGLPTDRDLGGACPPQDHDMQGLAERISVL

SEQ ID NO: 9285 - RNA, 2637 nt, Artificial Sequence
  PRKD2__Homo_sapiens__CCDS12689.1
auggccaccgcccccucuuaucccgccgggcucccuggcucucccgggccggggucuccuccgccccccggcggccuagagcugcagucgccgccaccgcuacugccccagaucccggccccggguuccggggucuccuuucacauccagaucgggcugacccgcgaguucgugcuguugcccgccgccuccgagcuggcucaugugaagcagcuggccuguuccaucguggaccagaaguucccugaguguggcuucuacggccuuuacgacaagauccugcuuuucaaacaugaccccacgucggccaaccuccugcagcuggugcgcucguccggagacauccaggagggcgaccugguggagguggugcugucggccucggccaccuucgaggacuuccagauccgcccgcacgcccucacggugcacuccuaucgggcgccugccuucugugaucacugcggggagaugcucuucggccuagugcgccagggccucaagugcgauggcugcgggcugaacuaccacaagcgcugugccuucagcauccccaacaacuguaguggggcccgcaaacggcgccugucauccacgucucuggccaguggccacucggugcgccucggcaccuccgagucccugcccugcacggcugaagagcugagccguagcaccaccgaacuccugccucgccgucccccgucauccucuuccuccucuucugccucaucguauacgggccgccccauugagcuggacaagaugcugcucuccaaggucaaggugccgcacaccuuccucauccacagcuauacacggcccaccguuugccaggcuugcaagaaacuccucaagggccucuuccggcagggccugcaaugcaaagacugcaaguuuaacugucacaaacgcugcgccacccgcgucccuaaugacugccugggggaggcccuuaucaauggagaugugccgauggaggaggccaccgauuucagcgaggcugacaagagcgcccucauggaugagucagaggacuccggugucaucccuggcucccacucagagaaugcgcuccacgccagugaggaggaggaaggcgagggaggcaaggcccagagcucccugggguacaucccccuaaugaggguggugcaaucggugcgacacacgacgcggaaauccagcaccacgcugcgggaggguugggugguucauuacagcaacaaggacacgcugagaaagcggcacuauuggcgccuggacugcaaguguaucacgcucuuccagaacaacacgaccaacagauacuauaaggaaauuccgcugucagaaauccucacgguggaguccgcccagaacuucagccuugugccgccgggcaccaacccacacugcuuugagaucgucacugccaaugccaccuacuucgugggcgagaugccuggcgggacuccgggugggccaagugggcagggggcugaggccgcccggggcugggagacagccauccgccaggcccugaugcccgucauccuucaggacgcacccagcgccccaggccacgcgccccacagacaagcuucucugagcaucucuguguccaacagucagauccaagagaauguggacauugccacugucuaccagaucuucccugacgaagugcugggcucagggcaguuuggaguggucuauggaggaaaacaccggaagacaggccgggacguggcaguuaaggucauugacaaacugcgcuucccuaccaagcaggagagccagcuccggaaugaaguggccauucugcagagccugcggcaucccgggaucgugaaccuggagugcauguucgagacgccugagaaaguguuuguggugauggagaagcugcauggggacauguuggagaugauccuguccagugagaagggccggcugccugagcgccucaccaaguuccucaucacccagauccugguggcuuugagacaccuucacuucaagaacauuguccacugugacuugaaaccagaaaacguguugcuggcaucagcagacccauuuccucaggugaagcugugugacuuuggcuuugcucgcaucaucggcgagaagucguuccgccgcucaguggugggcacgccggccuaccuggcacccgaggugcugcucaaccagggcuacaaccgcucgcuggacauguggucagugggcgugaucauguacgucagccucagcggcaccuucccuuucaacgaggaugaggacaucaaugaccagauccagaacgccgccuucauguacccggccagccccuggagccacaucucagcuggagccauugaccucaucaacaaccugcugcaggugaagaugcgcaaacgcuacagcguggacaaaucucucagccaccccugguuacaggaguaccagacguggcuggaccuccgagagcuggaggggaagaugggagagcgauacaucacgcaugagagugacgacgcgcgcugggagcaguuugcagcagagcauccgcugccugggucugggcugcccacggacagggaucucgguggggccuguccaccacaggaccacgacaugcaggggcuggcggagcgcaucaguguucucuga

SEQ ID NO: 9286 - RNA, 2637 nt, Artificial Sequence
  derived and/or modified sequence opt1 from PRKD2__Homo_sapiens__CCDS12689.1
auggccaccgcccccagcuacccggcgggccugcccgggucccccggccccgggagcccgcccccccccggcgggcucgagcugcaguccccgcccccccugcucccccagaucccggcccccggcagcggcguguccuuccacauccagaucgggcugacccgcgaguucguccugcuccccgccgccagcgagcuggcccacgugaagcagcuggcgugcuccaucguggaccagaaguuccccgagugcggcuucuacgggcucuacgacaagauccugcuguucaagcacgacccgacgagcgccaaccuccugcagcugguccgguccagcggcgacauccaggagggggaccucguggaggugguccuguccgccagcgccaccuucgaggacuuccagauccgcccccacgcgcugaccgugcacuccuaccgggcccccgccuucugcgaccacugcggcgagaugcucuucggccuggugcgccaggggcugaagugcgacggcugcgggcucaacuaccacaagcggugcgccuucagcauccccaacaacugcuccggcgcccgcaagcggcgccugagcuccaccagccuggcguccggccacagcguccggcucgggacgagcgagucccugccgugcaccgccgaggagcugagccgcuccaccaccgagcuccugccccggcgcccccccagcuccagcuccagcuccagcgccuccagcuacacgggccggccgaucgagcuggacaagaugcuccuguccaaggugaaggugccccacaccuuccugauccacagcuacacccgccccaccgucugccaggccugcaagaagcuccugaaggggcuguuccggcagggccuccagugcaaggacugcaaguucaacugccacaagcgcugcgccacgcgggugcccaacgacugccugggggaggcgcugaucaacggcgacgugccgauggaggaggccaccgacuucuccgaggccgacaagagcgcccucauggacgaguccgaggacagcggcgucauccccgggucccacagcgagaacgcccugcacgcgagcgaggaggaggagggcgaggggggcaaggcccaguccagccugggguacaucccccucaugcgcguggugcaguccguccggcacaccacccgcaagagcuccacgacccugcgggagggcuggguggugcacuacagcaacaaggacacccugcgcaagcgccacuacuggcggcucgacugcaagugcaucacccuguuccagaacaacacgaccaaccgcuacuacaaggagaucccgcuguccgagauccucaccgucgagagcgcccagaacuucucccuggugccccccggcaccaacccccacugcuucgagaucgugacggccaacgccaccuacuucgucggggagaugccgggcgggacccccggcgggcccagcggccagggcgcggaggccgcccgggggugggagaccgccauccgccaggcgcugaugcccgugauccugcaggacgccccguccgcccccggccacgccccccaccggcaggccagccucuccaucagcgucuccaacagccagauccaggagaacguggacaucgcgacgguguaccagaucuuccccgacgagguccugggguccggccaguucggcgugguguacgggggcaagcaccgcaagaccgggcgggacgucgccgugaaggugaucgacaagcugcgcuucccgaccaagcaggagagccagcuccggaacgaggucgccauccugcagagccugcgccaccccggcaucgugaaccucgagugcauguucgagacccccgagaagguguucgucgugauggagaagcugcacggggacaugcuggagaugauccucuccagcgagaagggccggcugcccgagcgccugacgaaguuccucaucacccagauccugguggcccugcggcaccuccacuucaagaacaucguccacugcgaccugaagccggagaacgugcugcucgccuccgcggaccccuucccccaggugaagcugugcgacuucggcuucgcccgcaucaucggggagaagagcuuccggcgcuccgucgugggcacccccgccuaccuggccccggaggugcuccugaaccagggguacaaccggagccuggacaugugguccgucggcgugaucauguacgugagccucuccgggaccuuccccuucaacgaggacgaggacaucaacgaccagauccagaacgccgcguucauguaccccgccagccccuggucccacaucagcgccggcgccaucgaccugaucaacaaccugcuccaggucaagaugcgcaagcgguacuccguggacaagagccugucccacccguggcugcaggaguaccagacguggcucgaccugcgcgagcuggagggcaagaugggggagcgcuacaucacccacgagagcgacgacgcgcggugggagcaguucgccgccgagcacccccuccccggcuccgggcugccgaccgaccgcgaccugggcggggccugccccccccaggaccacgacaugcagggccucgccgagcggaucagcgugcuguga

SEQ ID NO: 9287 - RNA, 2637 nt, Artificial Sequence
  derived and/or modified sequence opt2 from PRKD2__Homo_sapiens__CCDS12689.1
auggccaccgcccccuccuaccccgccggccuccccggcucccccggccccggcuccccccccccccccggcggccucgagcuccaguccccccccccccuccucccccagauccccgcccccggcuccggcgucuccuuccacauccagaucggccucacccgcgaguucguccuccuccccgccgccuccgagcucgcccacgucaagcagcucgccugcuccaucgucgaccagaaguuccccgagugcggcuucuacggccucuacgacaagauccuccucuucaagcacgaccccaccuccgccaaccuccuccagcucguccgcuccuccggcgacauccaggagggcgaccucgucgaggucguccucuccgccuccgccaccuucgaggacuuccagauccgcccccacgcccucaccguccacuccuaccgcgcccccgccuucugcgaccacugcggcgagaugcucuucggccucguccgccagggccucaagugcgacggcugcggccucaacuaccacaagcgcugcgccuucuccauccccaacaacugcuccggcgcccgcaagcgccgccucuccuccaccucccucgccuccggccacuccguccgccucggcaccuccgagucccuccccugcaccgccgaggagcucucccgcuccaccaccgagcuccucccccgccgcccccccuccuccuccuccuccuccuccgccuccuccuacaccggccgccccaucgagcucgacaagaugcuccucuccaaggucaaggucccccacaccuuccucauccacuccuacacccgccccaccgucugccaggccugcaagaagcuccucaagggccucuuccgccagggccuccagugcaaggacugcaaguucaacugccacaagcgcugcgccacccgcguccccaacgacugccucggcgaggcccucaucaacggcgacguccccauggaggaggccaccgacuucuccgaggccgacaaguccgcccucauggacgaguccgaggacuccggcgucauccccggcucccacuccgagaacgcccuccacgccuccgaggaggaggagggcgagggcggcaaggcccaguccucccucggcuacaucccccucaugcgcgucguccaguccguccgccacaccacccgcaaguccuccaccacccuccgcgagggcugggucguccacuacuccaacaaggacacccuccgcaagcgccacuacuggcgccucgacugcaagugcaucacccucuuccagaacaacaccaccaaccgcuacuacaaggagaucccccucuccgagauccucaccgucgaguccgcccagaacuucucccucgucccccccggcaccaacccccacugcuucgagaucgucaccgccaacgccaccuacuucgucggcgagaugcccggcggcacccccggcggccccuccggccagggcgccgaggccgcccgcggcugggagaccgccauccgccaggcccucaugcccgucauccuccaggacgcccccuccgcccccggccacgccccccaccgccaggccucccucuccaucuccgucuccaacucccagauccaggagaacgucgacaucgccaccgucuaccagaucuuccccgacgagguccucggcuccggccaguucggcgucgucuacggcggcaagcaccgcaagaccggccgcgacgucgccgucaaggucaucgacaagcuccgcuuccccaccaagcaggagucccagcuccgcaacgaggucgccauccuccagucccuccgccaccccggcaucgucaaccucgagugcauguucgagacccccgagaaggucuucgucgucauggagaagcuccacggcgacaugcucgagaugauccucuccuccgagaagggccgccuccccgagcgccucaccaaguuccucaucacccagauccucgucgcccuccgccaccuccacuucaagaacaucguccacugcgaccucaagcccgagaacguccuccucgccuccgccgaccccuucccccaggucaagcucugcgacuucggcuucgcccgcaucaucggcgagaaguccuuccgccgcuccgucgucggcacccccgccuaccucgcccccgagguccuccucaaccagggcuacaaccgcucccucgacaugugguccgucggcgucaucauguacgucucccucuccggcaccuuccccuucaacgaggacgaggacaucaacgaccagauccagaacgccgccuucauguaccccgccucccccuggucccacaucuccgccggcgccaucgaccucaucaacaaccuccuccaggucaagaugcgcaagcgcuacuccgucgacaagucccucucccaccccuggcuccaggaguaccagaccuggcucgaccuccgcgagcucgagggcaagaugggcgagcgcuacaucacccacgaguccgacgacgcccgcugggagcaguucgccgccgagcacccccuccccggcuccggccuccccaccgaccgcgaccucggcggcgccugccccccccaggaccacgacaugcagggccucgccgagcgcaucuccguccucuga

SEQ ID NO: 9288 - RNA, 2637 nt, Artificial Sequence
  derived and/or modified sequence opt3 from PRKD2__Homo_sapiens__CCDS12689.1
auggccaccgcucccagcuacccugcaggccugccaggguccccgggacccgguucuccuccacccccuggcgggcucgagcuucagucaccacccccucuguugccacaaaucccggcccccggaaguggcgugagcuuccacauucagauagguuuaacaagagaauuuguccugcuaccugcggcuuccgagcucgcccauguuaagcagcuggcaugcucuaucguggaccagaaauucccagaauguggguuuuauggacuuuacgauaagauucuguuguucaaacacgaccccacuucggccaaccuccugcaacugguaaggucaagcggcgauauccaggagggcgaccucguggaagucguguuaagugcuuccgcaacguuugaggauuuccagauucggccucaugcccugaccguucacucuuaucgcgcuccagccuuuugcgaccauuguggggagaugcuuuucggauuggugcgacagggucugaagugcgauggcugugggcuaaauuaccacaaacguugcgcguuuagcauccccaacaauuguuccggagcaagaaagaggcggcucucaaguacaagccuggccucuggccacuccguccgccuugguacuucagaaagccugccgugcaccgcugaggaauugaguagaucuacaaccgagcuccugccuaggcggcccccauccagcucgucuuccucaagugccagcuccuauacugggcgcccuauagaguuagacaagaugcugcucucuaaagugaagguaccccauacauuccuuauccacagcuacacccgaccaacgguuugucaagcaugcaaaaagcuguugaaaggacuauuuagacagggccugcaguguaaggauugcaaguucaacugccauaaaaggugugcuacucgggugcccaaugacugccucggcgaagcccugauuaacggggaugucccuauggaggaagcgaccgacuuuucagaggccgauaagagugcacuuauggacgaauccgaggacagcggagugaucccagguucucacucagagaaugcucugcacgccagugaagaggaagagggcgaagggggaaaagcucagagcuccuugggcuauauuccgcucaugcgugugguccaaucuguucgccauacaacuagaaagucgagcaccacacugagggaggguugggugguacacuacuccaacaaagauaccuuacggaagcgacauuacuggcgccuggacuguaaaugcaucacgcuauuccagaauaacacuacaaauagauauuacaaggagauaccccucucagaaauucugaccguggagagugcccagaacuucucucuugucccuccagggacuaauccccacuguuuugaaaucgugacagcaaacgccaccuauuucguuggcgagaugccuggaggcacgccagggggacccagcggucaaggcgcugaagcggcaagggggugggagaccgccauucggcaggcuuugaugccggugauccugcaggaugccccuuccgcaccaggacaugcuccccaccgccaggccucacucagcaucucugucuccaauagucaaauucaggagaacguggacauagccacaguauaccagaucuuuccugaugaaguucugggcagcggucaguucgggguggucuauggcggaaagcacagaaaaacuggcagggacguggcagucaaggugauugauaaacuucguuuucccaccaagcaagagucucagcugcggaacgaaguugcgaucuugcagucccuccgacauccagggauagugaaucuggagugcauguucgagacaccugaaaaaguauuugucgugauggagaaguuacacggagacaugcuggaaaugauucuaucaagugagaaggguagacuccccgaaaggcugacuaaauuccuuaucacccagaucuugguugcucugcgccaucuccacuuuaagaacauugugcacugugaucugaaaccagagaaugucuuacuggccagcgcagacccguucccucaagugaaacuuugcgauuuuggcuucgcccggaucauuggggagaagucguuuagaagguccguagugggaacacccgcuuacuuggccccagaaguucuccugaaccagggcuauaaucgcucucuagacauguggagcgucggugugauaauguacgugucacugagugggaccuuccccuucaacgaggacgaagauaucaaugaccagauucagaacgcagcuuuuauguacccugccuccccauggucucauaucagcgcgggcgccaucgaucucauuaauaaccugcuucaagucaagaugcgaaagcgguauuccguugacaaaucauugagccaccccuggcugcaggaguaccagacuugguuagaucuccgugaacuggagggaaagaugggcgagagauauauaacgcaugaaagugacgaugcuaggugggagcaauucgcagccgaacacccucuuccggggucuggacugccaacagaccgcgauuugggcggugcuugucccccucaggaccaugauaugcaggggcucgccgagcggaucuccgugcuguga

SEQ ID NO: 9289 - RNA, 2637 nt, Artificial Sequence
  derived and/or modified sequence opt4 from PRKD2__Homo_sapiens__CCDS12689.1
auggccaccgcccccagcuaccccgccggccugcccggcagccccggccccggcagcccccccccccccggcggccuggagcugcagagcccccccccccugcugccccagauccccgcccccggcagcggcgugagcuuccacauccagaucggccugaccagagaguucgugcugcugcccgccgccagcgagcuggcccacgugaagcagcuggccugcagcaucguggaccagaaguuccccgagugcggcuucuacggccuguacgacaagauccugcuguucaagcacgaccccaccagcgccaaccugcugcagcuggugagaagcagcggcgacauccaggagggcgaccugguggagguggugcugagcgccagcgccaccuucgaggacuuccagaucagaccccacgcccugaccgugcacagcuacagagcccccgccuucugcgaccacugcggcgagaugcuguucggccuggugagacagggccugaagugcgacggcugcggccugaacuaccacaagagaugcgccuucagcauccccaacaacugcagcggcgccagaaagagaagacugagcagcaccagccuggccagcggccacagcgugagacugggcaccagcgagagccugcccugcaccgccgaggagcugagcagaagcaccaccgagcugcugcccagaagaccccccagcagcagcagcagcagcagcgccagcagcuacaccggcagacccaucgagcuggacaagaugcugcugagcaaggugaaggugccccacaccuuccugauccacagcuacaccagacccaccgugugccaggccugcaagaagcugcugaagggccuguucagacagggccugcagugcaaggacugcaaguucaacugccacaagagaugcgccaccagagugcccaacgacugccugggcgaggcccugaucaacggcgacgugcccauggaggaggccaccgacuucagcgaggccgacaagagcgcccugauggacgagagcgaggacagcggcgugauccccggcagccacagcgagaacgcccugcacgccagcgaggaggaggagggcgagggcggcaaggcccagagcagccugggcuacaucccccugaugagaguggugcagagcgugagacacaccaccagaaagagcagcaccacccugagagagggcuggguggugcacuacagcaacaaggacacccugagaaagagacacuacuggagacuggacugcaagugcaucacccuguuccagaacaacaccaccaacagauacuacaaggagaucccccugagcgagauccugaccguggagagcgcccagaacuucagccuggugccccccggcaccaacccccacugcuucgagaucgugaccgccaacgccaccuacuucgugggcgagaugcccggcggcacccccggcggccccagcggccagggcgccgaggccgccagaggcugggagaccgccaucagacaggcccugaugcccgugauccugcaggacgcccccagcgcccccggccacgccccccacagacaggccagccugagcaucagcgugagcaacagccagauccaggagaacguggacaucgccaccguguaccagaucuuccccgacgaggugcugggcagcggccaguucggcgugguguacggcggcaagcacagaaagaccggcagagacguggccgugaaggugaucgacaagcugagauuccccaccaagcaggagagccagcugagaaacgagguggccauccugcagagccugagacaccccggcaucgugaaccuggagugcauguucgagacccccgagaagguguucguggugauggagaagcugcacggcgacaugcuggagaugauccugagcagcgagaagggcagacugcccgagagacugaccaaguuccugaucacccagauccugguggcccugagacaccugcacuucaagaacaucgugcacugcgaccugaagcccgagaacgugcugcuggccagcgccgaccccuucccccaggugaagcugugcgacuucggcuucgccagaaucaucggcgagaagagcuucagaagaagcguggugggcacccccgccuaccuggcccccgaggugcugcugaaccagggcuacaacagaagccuggacauguggagcgugggcgugaucauguacgugagccugagcggcaccuuccccuucaacgaggacgaggacaucaacgaccagauccagaacgccgccuucauguaccccgccagccccuggagccacaucagcgccggcgccaucgaccugaucaacaaccugcugcaggugaagaugagaaagagauacagcguggacaagagccugagccaccccuggcugcaggaguaccagaccuggcuggaccugagagagcuggagggcaagaugggcgagagauacaucacccacgagagcgacgacgccagaugggagcaguucgccgccgagcacccccugcccggcagcggccugcccaccgacagagaccugggcggcgccugccccccccaggaccacgacaugcagggccuggccgagagaaucagcgugcuguga

SEQ ID NO: 9290 - RNA, 2637 nt, Artificial Sequence
  derived and/or modified sequence opt5 from PRKD2__Homo_sapiens__CCDS12689.1
auggccaccgcucccagcuacccugccggccugccggggucccccggaccuggcucucccccucccccugggggacucgagcugcagagcccgcccccucuucugccccaaaucccugcgcccggcuccggggugucuuuccacauucagaucggacucacaagagaauuuguccugcuuccggcugccagcgagcuggcccauguuaagcagcucgcuugcuccauuguggaccagaaauucccugaauguggcuuuuauggccuguacgauaagauccuccuguucaaacacgaccccacgucugccaaccugcuucaacuggugcggagcuccggggauauucaggagggagaccucgucgaagugguucugagcgcuucugccaccuuugaggauuuccagauccgcccucaugcgcuuacagugcacuccuauagagcccccgcuuuuugcgaccauuguggcgagaugcuguucgggcucguccggcagggacugaagugcgauggcugugggcugaauuaccacaaacgcugcgccuuuagcauccccaacaauuguucuggagcuagaaagcggcgccucuccagcaccucucuggccuccggccacagcgugagacuuggcacauccgaaucucugccuugcaccgcggaggaacucagccgguccacaaccgagcugcuuccgcgcagacccccuagcagcuccagcucuagcuccgccucuagcuauacggggcggcccauugagcuggacaagaugcuccuguccaaaguuaaggugccucauaccuuccugauccacagcuacacacgccccaccgucugucaggcuugcaaaaagcuccugaaaggacuuuuuagacaaggccugcaguguaaggauugcaaguucaacugccauaaacggugugccacacgcgugccgaaugacugccucggggaagcucugauuaacggagaugugccuauggaggaagccaccgacuuuucugaggccgauaaguccgcucuuauggacgaaagcgaggacucuggcgucauccccgggucccacagcgagaaugcgcugcacgccuccgaagaggaagagggagaaggcggcaaagcucagucuagccucggguauauuccucugaugagaguugugcaauccgugcggcauacgacaagaaagucuagcaccacacugcgcgagggaugggucgugcacuacuccaacaaagauacccuccggaagagacauuacuggcgccuggacuguaaaugcaucacccuuuuccagaauaacacaacgaaucgguauuacaaggagauuccccugagcgaaauccucaccguugagucugcccagaacuucucccuggugccucccggcacaaauccgcacuguuuugaaaucgucaccgccaacgcuacauauuucgugggggagaugccuggaggcacccccgggggccccagcggacaaggcgccgaagcggcuagagggugggagacggccauucgccaggcccugaugccuguuauccuucaggaugcuccgucugcccccggacaugcuccucaccggcaggccucccucagcauuucugugagcaauucccaaauccaggagaacgucgacauugcgacaguguaccagaucuuucccgaugaaguccugggcagcgggcaguucggagugguuuauggcgggaagcacagaaaaaccggccgcgacguggccgucaaggugaucgauaaacugcgguuuccuaccaagcaagagucucagcucagaaacgaaguugcuauucugcagucccuucgccaucccggaaucgugaaucuggagugcauguucgagacaccugaaaaagucuuuguggugauggagaagcuccacggcgacaugcuggaaaugauucugagcuccgagaaggggcggcuucccgaaagacucaccaaauuccugaucacacagauucugguugcccuccggcaucugcacuuuaagaacaucguccacugugaucuuaaaccggagaaugugcugcucgcuucugccgacccuuucccccaagugaagcugugcgauuuuggauucgcgcgcaucauuggcgagaaaucuuuuagacgguccgucguggggacgccugccuaccuggcucccgaaguucuucucaaccagggauauaauagaucucuggacauguggagcgugggcgucaucauguacgugucccugucugggaccuucccguucaacgaggacgaagauauuaaugaccagauccagaacgccgcuuuuauguacccugccagccccuggucccauauuagcgccggcgcuaucgaucucauuaauaaccugcuucaaguuaagaugcgcaagcgguauucuguggacaaaucccugagccacccuuggcuccaggaguaccagacauggcuggaucugagagaacuugagggaaagaugggcgagcgcuauaucacccaugaaucugacgaugcgagaugggagcaauucgccgcugaacacccccuccccggguccggacugccuacagaccgggaucugggcggggccuguccgccccaggaccaugauaugcagggacucgccgagcgcaucagcguccuguga

SEQ ID NO: 9291 - protein, 562 aa, Artificial Sequence
  Rab__Homo_sapiens__P52594
MAASAKRKQEEKHLKMLRDMTGLPHNRKCFDCDQRGPTYVNMTVGSFVCTSCSGSLRGLNPPHRVKSISMTTFTQQEIEFLQKHGNEVCKQIWLGLFDDRSSAIPDFRDPQKVKEFLQEKYEKKRWYVPPEQAKVVASVHASISGSSASSTSSTPEVKPLKSLLGDSAPTLHLNKGTPSQSPVVGRSQGQQQEKKQFDLLSDLGSDIFAAPAPQSTATANFANFAHFNSHAAQNSANADFANFDAFGQSSGSSNFGGFPTASHSPFQPQTTGGSAASVNANFAHFDNFPKSSSADFGTFNTSQSHQTASAVSKVSTNKAGLQTADKYAALANLDNIFSAGQGGDQGSGFGTTGKAPVGSVVSVPSQSSASSDKYAALAELDSVFSSAATSSNAYTSTSNASSNVFGTVPVVASAQTQPASSSVPAPFGATPSTNPFVAAAGPSVASSTNPFQTNARGATAATFGTASMSMPTGFGTPAPYSLPTSFSGSFQQPAFPAQAAFPQQTAFSQQPNGAGFAAFGQTKPVVTPFGQVAAAGVSSNPFMTGAPTGQFPTGSSSTNPFL

SEQ ID NO: 9292 - RNA, 1689 nt, Artificial Sequence
  Rab__Homo_sapiens__AAC37580
auggcggccagcgcgaagcggaagcaggaggagaagcaccugaagaugcugcgggacaugaccggccucccgcacaaccgaaagugcuucgacugcgaccagcgcggccccaccuacguuaacaugacggucggcuccuucguguguaccuccugcuccggcagccugcgaggauuaaauccaccacacagggugaaaucuaucuccaugacaacauucacacaacaggaaauugaauucuuacaaaaacauggaaaugaagucuguaaacagauuuggcuaggauuauuugaugauagaucuucagcaauuccagacuucagggauccacaaaaagugaaagaguuucuacaagaaaaguaugaaaagaaaagaugguaugucccgccagaacaagccaaagucguggcaucaguucaugcaucuauuucaggguccucugccaguagcacaagcagcacaccugaggucaaaccacugaaaucucuuuuaggggauucugcaccaacacugcacuuaaauaagggcacaccuagucaguccccaguuguaggucguucucaagggcagcagcaggagaagaagcaauuugaccuuuuaagugaucucggcucagacaucuuugcugcuccagcuccucagucaacagcuacagccaauuuugcuaacuuugcacauuucaacagucaugcagcucagaauucugcaaaugcagauuuugcaaacuuugaugcauuuggacagucuagugguucgaguaauuuuggagguuuccccacagcaagucacucuccuuuucagccccaaacuacagguggaagugcugcaucaguaaaugcuaauuuugcucauuuugauaacuuccccaaauccuccagugcugauuuuggaaccuucaauacuucccagagucaucaaacagcaucagcuguuaguaaaguuucaacgaacaaagcugguuuacagacugcagacaaauaugcagcacuugcuaauuuagacaauaucuucagugccgggcaagguggugaucagggaaguggcuuugggaccacagguaaagcuccuguugguucugugguuucaguucccagucagucaagugcaucuucagacaaguaugcagcucuggcagaacuagacagcguuuucaguucugcagccaccuccaguaaugcguauacuuccacaaguaaugcuagcagcaauguuuuuggaacagugccagugguugcuucugcacagacacagccugcuucaucaagugugccugcuccauuuggagcuacgccuuccacaaauccauuuguugcugcugcugguccuucuguggcaucuucuacaaacccauuucagaccaaugccagaggagcaacagcggcaaccuuuggcacugcauccaugagcaugcccacgggauucggcacuccugcucccuacagucuucccaccagcuuuaguggcagcuuucagcagccugccuuuccagcccaagcagcuuucccucaacagacagcuuuuucucaacagcccaauggugcagguuuugcagcauuuggacaaacaaagccaguaguaaccccuuuuggucaaguugcagcugcuggaguaucuaguaauccuuuuaugacuggugcaccaacaggacaauuuccaacaggaagcucaucaaccaauccuuucuuauag

SEQ ID NO: 9293 - RNA, 1689 nt, Artificial Sequence
  derived and/or modified sequence opt1 from Rab__Homo_sapiens__AAC37580
auggccgccagcgcgaagcgcaagcaggaggagaagcaccugaagaugcuccgggacaugaccggccugccccacaaccgcaagugcuucgacugcgaccagcgggggccgaccuacgugaacaugacggucggcuccuucgugugcaccagcugcuccgggagccugcgcggccucaacccgccccaccgggugaaguccaucagcaugaccaccuucacgcagcaggagaucgaguuccugcagaagcacgggaacgaggucugcaagcagaucuggcugggccucuucgacgaccgcuccagcgccauccccgacuuccgggacccccagaaggugaaggaguuccugcaggagaaguacgagaagaagcgcugguacgugccgcccgagcaggccaaggucguggccuccgugcacgccagcaucuccggcagcuccgcgagcuccaccagcuccacccccgaggucaagccccucaagagccugcugggggacuccgcccccacccugcaccucaacaagggcacgcccagccagagccccgugguggggcggucccagggccagcagcaggagaagaagcaguucgaccugcugagcgaccucggguccgacaucuucgccgccccggcgccccagagcaccgccaccgccaacuucgccaacuucgcccacuucaacucccacgcggcccagaacagcgccaacgccgacuucgccaacuucgacgcguucggccaguccagcggcuccagcaacuucgggggcuuccccaccgccucccacagccccuuccagccgcagacgaccgggggcuccgccgccagcgucaacgccaacuucgcgcacuucgacaacuuccccaaguccagcuccgccgacuucggcaccuucaacaccagccagucccaccagacggccagcgccgugagcaagguguccaccaacaaggccgggcugcagaccgcggacaaguacgccgcccuggccaaccucgacaacaucuucagcgcgggccagggcggggaccagggguccggcuucggcaccacggggaaggcccccgucggcagcgugguguccguccccagccaguccagcgccuccagcgacaaguacgccgcccuggcggagcuggacuccguguucagcuccgccgccaccagcuccaacgccuacaccagcaccuccaacgccagcagcaacguguucgggacggucccggugguggcguccgcccagacccagcccgccagcuccagcguccccgcccccuucggcgccaccccguccaccaaccccuucguggcggccgccgggcccagcgucgccuccagcacgaaccccuuccagaccaacgcgcgcggcgccaccgccgccaccuucggcacggccuccaugagcaugccgaccggguucggcacccccgcgcccuacucccucccgaccagcuucuccgggagcuuccagcagcccgccuuccccgcccaggccgccuucccccagcagacggcguucucccagcagccgaacggcgccggguucgccgccuucggccagaccaagcccguggugacccccuucggccaggucgccgcggccggggugagcuccaaccccuucaugaccggcgccccgaccgggcaguuccccacgggcagcuccagcaccaaccccuuccuguga

SEQ ID NO: 9294 - RNA, 1689 nt, Artificial Sequence
  derived and/or modified sequence opt2 from Rab__Homo_sapiens__AAC37580
auggccgccuccgccaagcgcaagcaggaggagaagcaccucaagaugcuccgcgacaugaccggccucccccacaaccgcaagugcuucgacugcgaccagcgcggccccaccuacgucaacaugaccgucggcuccuucgucugcaccuccugcuccggcucccuccgcggccucaaccccccccaccgcgucaaguccaucuccaugaccaccuucacccagcaggagaucgaguuccuccagaagcacggcaacgaggucugcaagcagaucuggcucggccucuucgacgaccgcuccuccgccauccccgacuuccgcgacccccagaaggucaaggaguuccuccaggagaaguacgagaagaagcgcugguacgucccccccgagcaggccaaggucgucgccuccguccacgccuccaucuccggcuccuccgccuccuccaccuccuccacccccgaggucaagccccucaagucccuccucggcgacuccgcccccacccuccaccucaacaagggcacccccucccagucccccgucgucggccgcucccagggccagcagcaggagaagaagcaguucgaccuccucuccgaccucggcuccgacaucuucgccgcccccgccccccaguccaccgccaccgccaacuucgccaacuucgcccacuucaacucccacgccgcccagaacuccgccaacgccgacuucgccaacuucgacgccuucggccaguccuccggcuccuccaacuucggcggcuuccccaccgccucccacucccccuuccagccccagaccaccggcggcuccgccgccuccgucaacgccaacuucgcccacuucgacaacuuccccaaguccuccuccgccgacuucggcaccuucaacaccucccagucccaccagaccgccuccgccgucuccaaggucuccaccaacaaggccggccuccagaccgccgacaaguacgccgcccucgccaaccucgacaacaucuucuccgccggccagggcggcgaccagggcuccggcuucggcaccaccggcaaggcccccgucggcuccgucgucuccguccccucccaguccuccgccuccuccgacaaguacgccgcccucgccgagcucgacuccgucuucuccuccgccgccaccuccuccaacgccuacaccuccaccuccaacgccuccuccaacgucuucggcaccguccccgucgucgccuccgcccagacccagcccgccuccuccuccguccccgcccccuucggcgccacccccuccaccaaccccuucgucgccgccgccggccccuccgucgccuccuccaccaaccccuuccagaccaacgcccgcggcgccaccgccgccaccuucggcaccgccuccauguccaugcccaccggcuucggcacccccgcccccuacucccuccccaccuccuucuccggcuccuuccagcagcccgccuuccccgcccaggccgccuucccccagcagaccgccuucucccagcagcccaacggcgccggcuucgccgccuucggccagaccaagcccgucgucacccccuucggccaggucgccgccgccggcgucuccuccaaccccuucaugaccggcgcccccaccggccaguuccccaccggcuccuccuccaccaaccccuuccucuga

SEQ ID NO: 9295 - RNA, 1689 nt, Artificial Sequence
  derived and/or modified sequence opt3 from Rab__Homo_sapiens__AAC37580
auggccgcuagcgcaaagagaaaacaggaggaaaagcaccugaaaaugcucagggacaugaccggccuuccccauaaccggaagugcuucgauugugaccaacgcgggccuacauacgugaauaugacugucggauccuuuguuugcacgucuuguucagguagucugcgaggcuugaacccaccgcaccgugugaaaagcaucuccaugaccacauucacucagcaggagauugaauuuuuacagaagcaugggaaugagguaugcaagcaaauauggcugggacuauucgaugacagaucuucggccauccccgauuuuagggacccucagaaagugaaggaguuccuccaggaaaaauaugagaagaaacggugguacgucccacccgaacaggcgaaggugguugcuucagugcacgccagcauuaguggcuccucugcaagcuccaccucaaguacaccugaggucaagccacugaaaagccuucugggugauucugcccccaccuugcaucucaacaaggggacuccuucccaaucaccagugguaggacgcagccagggccagcagcaagagaaaaagcaguuugaccugcugagugaucucggcucugacaucuucgcugcaccggcuccccaguccacagccaccgccaauuuugcgaacuucgcacacuuuaauagccacgccgcucaaaacucggccaaugcagauuucgcuaacuuugacgccuucgggcagucuuccggaucaaguaauuucgguggcuuuccuacggcgagccauuccccauuccagccccagacuaccgggggaucugccgcaagcguuaacgcuaauuuugcccacuucgauaacuuuccuaaaucaaguuccgcugacuucggcacauuuaauacuagccaaucucaucagaccgccucagcagugaguaaggucagcacaaacaaagccgguuuacagaccgcugacaaguaugcggcacuggccaaccuugauaauauuuucuccgcugggcagggaggcgaccaaggcucuggguuuggaacgacugguaaggccccagugggcucgguggucagcguucccucccagucaagugcaucuagcgauaaauacgccgcuuuggccgaacuggacuccguguucucaagcgcagcgacaucuuccaacgcuuauaccaguacuagcaaugccucuuccaacguauuugggacagugccggucguggcaucagcccagacccagccugcuaguagcucgguucccgccccauucggagcaacgccuuccaccaaucccuuuguggcugccgcgggcccaucugucgccagcucaacaaaccccuuccaaacuaaugcuagaggugcaaccgccgcuacauucgggacugccaguauguccaugccuaccggcuuuggaacaccagcaccguacucucuacccaccagcuucuccggcucauuucagcagccugcguucccagcccaggcugccuuuccccaacagacugcauucagccagcaaccuaacggggcuggauuugccgcauucggucagacgaagccagugguaacacccuuuggccagguugccgcugcgggggugaguucuaauccguucaugaccggagccccuacuggccaguuuccaaccgguuccagcucgacaaaccccuuccucuga

SEQ ID NO: 9296 - RNA, 1689 nt, Artificial Sequence
  derived and/or modified sequence opt4 from Rab__Homo_sapiens__AAC37580
auggccgccagcgccaagagaaagcaggaggagaagcaccugaagaugcugagagacaugaccggccugccccacaacagaaagugcuucgacugcgaccagagaggccccaccuacgugaacaugaccgugggcagcuucgugugcaccagcugcagcggcagccugagaggccugaaccccccccacagagugaagagcaucagcaugaccaccuucacccagcaggagaucgaguuccugcagaagcacggcaacgaggugugcaagcagaucuggcugggccuguucgacgacagaagcagcgccauccccgacuucagagacccccagaaggugaaggaguuccugcaggagaaguacgagaagaagagaugguacgugccccccgagcaggccaaggugguggccagcgugcacgccagcaucagcggcagcagcgccagcagcaccagcagcacccccgaggugaagccccugaagagccugcugggcgacagcgcccccacccugcaccugaacaagggcacccccagccagagccccguggugggcagaagccagggccagcagcaggagaagaagcaguucgaccugcugagcgaccugggcagcgacaucuucgccgcccccgccccccagagcaccgccaccgccaacuucgccaacuucgcccacuucaacagccacgccgcccagaacagcgccaacgccgacuucgccaacuucgacgccuucggccagagcagcggcagcagcaacuucggcggcuuccccaccgccagccacagccccuuccagccccagaccaccggcggcagcgccgccagcgugaacgccaacuucgcccacuucgacaacuuccccaagagcagcagcgccgacuucggcaccuucaacaccagccagagccaccagaccgccagcgccgugagcaaggugagcaccaacaaggccggccugcagaccgccgacaaguacgccgcccuggccaaccuggacaacaucuucagcgccggccagggcggcgaccagggcagcggcuucggcaccaccggcaaggcccccgugggcagcguggugagcgugcccagccagagcagcgccagcagcgacaaguacgccgcccuggccgagcuggacagcguguucagcagcgccgccaccagcagcaacgccuacaccagcaccagcaacgccagcagcaacguguucggcaccgugcccgugguggccagcgcccagacccagcccgccagcagcagcgugcccgcccccuucggcgccacccccagcaccaaccccuucguggccgccgccggccccagcguggccagcagcaccaaccccuuccagaccaacgccagaggcgccaccgccgccaccuucggcaccgccagcaugagcaugcccaccggcuucggcacccccgcccccuacagccugcccaccagcuucagcggcagcuuccagcagcccgccuuccccgcccaggccgccuucccccagcagaccgccuucagccagcagcccaacggcgccggcuucgccgccuucggccagaccaagcccguggugacccccuucggccagguggccgccgccggcgugagcagcaaccccuucaugaccggcgcccccaccggccaguuccccaccggcagcagcagcaccaaccccuuccuguga

SEQ ID NO: 9297 - RNA, 1689 nt, Artificial Sequence
  derived and/or modified sequence opt5 from Rab__Homo_sapiens__AAC37580
auggccgcuagcgccaagagaaaacaggaggaaaagcaccugaaaaugcuccgggacaugaccggccugccccauaaccgcaagugcuucgauugugaccaaagagggccuacauacgugaauaugacggucggauccuuuguuugcaccucuuguagcggcucccuucgggggcugaacccgccccaccgcgugaaaucuaucagcaugacaaccuucacacagcaggagauugaauuucuccagaagcauggaaaugaggugugcaagcaaaucuggcugggccuuuucgaugacagauccucugcgauuccugauuuucgggacccccagaaagucaaggaguuccugcaggaaaaauaugagaagaaacgcugguacgugccucccgaacaggcuaagguuguggccagcguccacgccuccaucagcgggucuuccgcuagcucuaccuccagcacaccugaggugaagccgcucaaaucucugcugggagauuccgcccccacccuccaucugaacaagggcacgccuagccaaucccccguugugggcagaucucaggggcagcagcaagagaaaaagcaguuugaccuucugagcgaucucggauccgacauuuucgcugccccugcgccccagagcaccgccacagcuaauuuugccaacuucgcucacuuuaauucucacgccgcgcaaaacuccgccaaugcugauuucgccaacuuugacgcuuucggccagagcucugggagcuccaauuucggaggcuuuccgaccgccucucauagcccuuuccagccccagacaaccgggggauccgccgcuagcgucaacgcgaauuuugcccacuucgauaacuuuccuaaaucuuccagcgcugacuucggcacguuuaauacaucucaaucccaucagaccgccagcgccguguccaaggugucuacaaacaaagcuggccugcagaccgccgacaaguaugcggcucuugccaaccuggauaauaucuucagcgccgggcagggaggcgaccaaggguccggauuuggcaccacagggaaggcucccgucggaucuguugugagcgugcccucccagagcucugccuccagcgauaaauacgcugcccucgcggaacuggacucugucuucuccagcgccgcuacgucuagcaacgccuauaccuccacaagcaaugcuucuuccaacguguuuggcaccguuccuguggucgccagcgcgcagacacagccggccuccucuagcgugcccgcuccuuucggcgccacccccuccacgaauccuuuuguugcugccgccgggcccucuguggcuagcuccacaaacccguuccaaaccaaugcgcggggagccaccgcugccacauucggcaccgccucuaugagcaugccuacaggguuuggaacgcccgcuccuuacucccugcccaccagcuucucuggcuccuuucagcagccugccuuccccgcgcaggcugccuuuccgcaacagacagccuucagccagcaaccuaacggggcuggcuuugccgcguucggacagaccaagcccgucgugacacccuuuggccaggucgcugccgccggggugucuuccaauccuuucaugaccggagcuccgacgggccaguuucccaccgggucuagcuccacaaacccuuuccucuga

SEQ ID NO: 9298 - protein, 211 aa, Artificial Sequence
  Rac1__Homo_sapiens__A4D2P0
MQAIKCVVVGDGAVGKTCLLISYTTNAFPGEYIPTVFDNYSANVMVDGKPVNLGLWDTAGQEDYDRLRPLSYPQTVGETYGKDITSRGKDKPIADVFLICFSLVSPASFENVRAKWYPEVRHHCPNTPIILVGTKLDLRDDKDTIEKLKEKKLTPITYPQGLAMAKEIGAVKYLECSALTQRGLKTVFDEAIRAVLCPPPVKKRKRKCLLL

SEQ ID NO: 9299 - RNA, 636 nt, Artificial Sequence
  Rac1__Homo_sapiens__BAF84504
augcaggccaucaagugugugguggugggagacggagcuguagguaaaacuugccuacugaucaguuacacaaccaaugcauuuccuggagaauauaucccuacugucuuugacaauuauucugccaauguuaugguagauggaaaaccggugaaucugggcuuaugggauacagcuggacaagaagauuaugacagauuacgcccccuauccuauccgcaaacaguuggagaaacguacgguaaggauauaaccucccggggcaaagacaagccgauugccgauguguucuuaauuugcuuuucccuugugaguccugcaucauuugaaaauguccgugcaaagugguauccugaggugcggcaccacugucccaacacucccaucauccuagugggaacuaaacuugaucuuagggaugauaaagacacgaucgagaaacugaaggagaagaagcugacucccaucaccuauccgcagggucuagccauggcuaaggagauuggugcuguaaaauaccuggagugcucggcgcucacacagcgaggccucaagacaguguuugacgaagcgauccgagcaguccucugcccgccucccgugaagaagaggaagagaaaaugccugcuguuguaa

SEQ ID NO: 9300 - RNA, 636 nt, Artificial Sequence
  derived and/or modified sequence opt1 from Rac1__Homo_sapiens__BAF84504
augcaggccaucaagugcguggucgugggcgacggggccgugggcaagaccugccugcucaucagcuacaccacgaacgcguuccccggggaguacauccccaccgucuucgacaacuacuccgccaacgugaugguggacggcaagcccgucaaccuggggcugugggacaccgccggccaggaggacuacgaccgccuccggccccugagcuacccccagaccgugggcgagacguacgggaaggacaucaccucccgcggcaaggacaagccgaucgccgacguguuccugaucugcuucagccucgucucccccgccagcuucgagaacgugcgggcgaagugguaccccgaggugcgccaccacugccccaacaccccgaucauccuggucgggaccaagcuggaccuccgggacgacaaggacacgaucgagaagcugaaggagaagaagcugacccccaucaccuacccccagggccucgccauggccaaggagaucggggccgugaaguaccuggagugcuccgcgcugacccagcgcggccucaagacgguguucgacgaggccauccgggccguccugugcccgccgcccgugaagaagcgcaagcggaagugccugcuccuguga

SEQ ID NO: 9301 - RNA, 636 nt, Artificial Sequence
  derived and/or modified sequence opt2 from Rac1__Homo_sapiens__BAF84504
augcaggccaucaagugcgucgucgucggcgacggcgccgucggcaagaccugccuccucaucuccuacaccaccaacgccuuccccggcgaguacauccccaccgucuucgacaacuacuccgccaacgucauggucgacggcaagcccgucaaccucggccucugggacaccgccggccaggaggacuacgaccgccuccgcccccucuccuacccccagaccgucggcgagaccuacggcaaggacaucaccucccgcggcaaggacaagcccaucgccgacgucuuccucaucugcuucucccucgucucccccgccuccuucgagaacguccgcgccaagugguaccccgagguccgccaccacugccccaacacccccaucauccucgucggcaccaagcucgaccuccgcgacgacaaggacaccaucgagaagcucaaggagaagaagcucacccccaucaccuacccccagggccucgccauggccaaggagaucggcgccgucaaguaccucgagugcuccgcccucacccagcgcggccucaagaccgucuucgacgaggccauccgcgccguccucugccccccccccgucaagaagcgcaagcgcaagugccuccuccucuga

SEQ ID NO: 9302 - RNA, 636 nt, Artificial Sequence
  derived and/or modified sequence opt3 from Rac1__Homo_sapiens__BAF84504
augcaggccaucaagugcguggucguuggcgacggggcugugggaaaaaccugucugcucauuagcuacacaacuaacgcauuccccggugaguauauaccuacgguauuugauaauuacuccgccaacgugauggucgacggcaagccagugaaucuugggcugugggauaccgcgggacaagaagacuaugauagauugaggccguuaucuuacccccagacaguuggcgagacuuaugguaaagacaucaccucacgggggaaggauaaaccuauugcugacguguuccugaucugcuuuagucuagucagcccagccuccuucgaaaacgugcgcgcaaagugguaccccgagguacgacaccauuguccuaauacaccaauuauccucguuggaaccaagcuggaucuucgugacgauaaagacacuauagaaaagcugaaagagaagaaauugacacccaucaccuauccucagggccucgccauggcuaaggagauuggcgcagugaaguaccuggaaugcucugcccugacgcagagagggcucaaaacugucuuugaugaggcuaucagggccguguuauguccaccgcccgugaagaaacggaagcgcaaaugccugcuuuuguga

SEQ ID NO: 9303 - RNA, 636 nt, Artificial Sequence
  derived and/or modified sequence opt4 from Rac1__Homo_sapiens__BAF84504
augcaggccaucaagugcgugguggugggcgacggcgccgugggcaagaccugccugcugaucagcuacaccaccaacgccuuccccggcgaguacauccccaccguguucgacaacuacagcgccaacgugaugguggacggcaagcccgugaaccugggccugugggacaccgccggccaggaggacuacgacagacugagaccccugagcuacccccagaccgugggcgagaccuacggcaaggacaucaccagcagaggcaaggacaagcccaucgccgacguguuccugaucugcuucagccuggugagccccgccagcuucgagaacgugagagccaagugguaccccgaggugagacaccacugccccaacacccccaucauccuggugggcaccaagcuggaccugagagacgacaaggacaccaucgagaagcugaaggagaagaagcugacccccaucaccuacccccagggccuggccauggccaaggagaucggcgccgugaaguaccuggagugcagcgcccugacccagagaggccugaagaccguguucgacgaggccaucagagccgugcugugccccccccccgugaagaagagaaagagaaagugccugcugcuguga

SEQ ID NO: 9304 - RNA, 636 nt, Artificial Sequence
  derived and/or modified sequence opt5 from Rac1__Homo_sapiens__BAF84504
augcaggccaucaagugcguggucguuggcgacggggcugugggaaaaaccugucugcucauuagcuacacaacgaacgccuuccccggcgaguauaucccuaccguguuugauaauuacuccgcgaacgucaugguggacgggaagccgguuaaucugggacuuugggauacagcuggccaagaagacuaugauagacugcggccccucucuuacccucagaccgugggggagacauauggaaaagacauuaccagccgcggcaaggauaaacccaucgccgacgucuuccugauuugcuuuucccuugugucuccugccagcuucgaaaacguuagagcuaagugguaccccgaggugcggcaccauuguccuaauacaccgaucauccuggucggcaccaagcucgaucugcgcgacgauaaagacacgauugaaaagcugaaagagaagaaacucacccccaucacauauccucaggggcuggccauggcuaaggagauuggagccgugaaguaccuugaaugcuccgcgcugacccagagaggccucaaaacaguguuugaugaggccauccgggcuguccugugucccccucccguuaagaaacgcaagagaaaaugccuucugcucuga

SEQ ID NO: 9305 - protein, 192 aa, Artificial Sequence
  Rac1__Homo_sapiens__A4D2P1
MQAIKCVVVGDGAVGKTCLLISYTTNAFPGEYIPTVFDNYSANVMVDGKPVNLGLWDTAGQEDYDRLRPLSYPQTDVFLICFSLVSPASFENVRAKWYPEVRHHCPNTPIILVGTKLDLRDDKDTIEKLKEKKLTPITYPQGLAMAKEIGAVKYLECSALTQRGLKTVFDEAIRAVLCPPPVKKRKRKCLLL

SEQ ID NO: 9306 - RNA, 579 nt, Artificial Sequence
  Rac1__Homo_sapiens__BAF84495
augcaggccaucaagugugugguggugggagacggagcuguagguaaaacuugccuacugaucaguuacacaaccaaugcauuuccuggagaauauaucccuacugucuuugacaauuauucugccaauguuaugguagauggaaaaccggugaaucugggcuuaugggauacagcuggacaagaagauuaugacagauuacgcccccuauccuauccgcaaacagauguguucuuaauuugcuuuucccuugugaguccugcaucauuugaaaauguccgugcaaagugguauccugaggugcggcaccacugucccaacacucccaucauccuagugggaacuaaacuugaucuuagggaugauaaagacacgaucgagaaacugaaggagaagaagcugacucccaucaccuauccgcagggucuagccauggcuaaggagauuggugcuguaaaauaccuggagugcucggcgcucacacagcgaggccucaagacaguguuugacgaagcgauccgagcaguccucugcccgccucccgugaagaagaggaagagaaaaugccugcuguuguaa

SEQ ID NO: 9307 - RNA, 579 nt, Artificial Sequence
  derived and/or modified sequence opt1 from Rac1__Homo_sapiens__BAF84495
augcaggccaucaagugcguggucgugggcgacggggccgugggcaagaccugccugcucaucagcuacaccacgaacgcguuccccggggaguacauccccaccgucuucgacaacuacuccgccaacgugaugguggacggcaagcccgucaaccuggggcugugggacaccgccggccaggaggacuacgaccgccuccggccccugagcuacccccagaccgacguguuccugaucugcuucucccucgugagcccggccuccuucgagaacguccgcgccaagugguaccccgaggugcggcaccacugccccaacacgcccaucauccuggugggcaccaagcuggaccuccgcgacgacaaggacaccaucgagaagcugaaggagaagaagcugaccccgaucacguacccccaggggcucgcgauggccaaggagaucggcgccgucaaguaccuggagugcagcgcccugacccagcgggggcucaagaccguguucgacgaggcgauccgcgccgugcugugcccgccgcccgucaagaagcggaagcgcaagugccugcuccuguga

SEQ ID NO: 9308 - RNA, 579 nt, Artificial Sequence
  derived and/or modified sequence opt2 from Rac1__Homo_sapiens__BAF84495
augcaggccaucaagugcgucgucgucggcgacggcgccgucggcaagaccugccuccucaucuccuacaccaccaacgccuuccccggcgaguacauccccaccgucuucgacaacuacuccgccaacgucauggucgacggcaagcccgucaaccucggccucugggacaccgccggccaggaggacuacgaccgccuccgcccccucuccuacccccagaccgacgucuuccucaucugcuucucccucgucucccccgccuccuucgagaacguccgcgccaagugguaccccgagguccgccaccacugccccaacacccccaucauccucgucggcaccaagcucgaccuccgcgacgacaaggacaccaucgagaagcucaaggagaagaagcucacccccaucaccuacccccagggccucgccauggccaaggagaucggcgccgucaaguaccucgagugcuccgcccucacccagcgcggccucaagaccgucuucgacgaggccauccgcgccguccucugccccccccccgucaagaagcgcaagcgcaagugccuccuccucuga

SEQ ID NO: 9309 - RNA, 579 nt, Artificial Sequence
  derived and/or modified sequence opt3 from Rac1__Homo_sapiens__BAF84495
augcaggccaucaagugcguggucguuggcgacggggcugugggaaaaaccugucugcucauuagcuacacaacuaacgcauuccccggugaguauauaccuacgguauuugauaauuacuccgccaacgugauggucgacggcaagccagugaaucuugggcugugggauaccgcgggacaagaagacuaugauagauugaggccguuaucuuacccccagacagacguuuuccugaucugcuuuucacucgugaguccugcuagcuucgagaacguccgggccaaaugguauccagaagugcgccaccauugucccaauacuccuauuauccuaguaggcaccaagcuggaucuucgagacgauaaagacacaauugagaagcugaaggagaaaaaguugaccccaaucacuuacccccagggucucgcaauggccaaagaaauaggggcuguuaaguaucuggagugcuccgcacugacacagcguggacucaaaaccguguuugaugaagccaucagagcugucuuauguccuccaccggugaagaagaggaaacggaagugccugcuuuuguga

SEQ ID NO: 9310 - RNA, 579 nt, Artificial Sequence
  derived and/or modified sequence opt4 from Rac1__Homo_sapiens__BAF84495
augcaggccaucaagugcgugguggugggcgacggcgccgugggcaagaccugccugcugaucagcuacaccaccaacgccuuccccggcgaguacauccccaccguguucgacaacuacagcgccaacgugaugguggacggcaagcccgugaaccugggccugugggacaccgccggccaggaggacuacgacagacugagaccccugagcuacccccagaccgacguguuccugaucugcuucagccuggugagccccgccagcuucgagaacgugagagccaagugguaccccgaggugagacaccacugccccaacacccccaucauccuggugggcaccaagcuggaccugagagacgacaaggacaccaucgagaagcugaaggagaagaagcugacccccaucaccuacccccagggccuggccauggccaaggagaucggcgccgugaaguaccuggagugcagcgcccugacccagagaggccugaagaccguguucgacgaggccaucagagccgugcugugccccccccccgugaagaagagaaagagaaagugccugcugcuguga

SEQ ID NO: 9311 - RNA, 579 nt, Artificial Sequence
  derived and/or modified sequence opt5 from Rac1__Homo_sapiens__BAF84495
augcaggccaucaagugcguggucguuggcgacggggcugugggaaaaaccugucugcucauuagcuacacaacgaacgccuuccccggcgaguauaucccuaccguguuugauaauuacuccgcgaacgucaugguggacgggaagccgguuaaucugggacuuugggauacagcuggccaagaagacuaugauagacugcggccccucucuuacccucagaccgacguguuccugauuugcuuuagccuugucucccccgccucuuucgagaacgugcgcgccaaaugguauccugaaguuagacaccauugucccaauacaccuaucauucugguggggaccaagcucgaucugcgggacgauaaagacacaaucgagaagcugaaggagaaaaagcucaccccgaucacguacccccagggacuggcuauggccaaagaaauuggcgcugucaaguaucuugagugcagcgcccugacccagcgcggccucaaaacaguguuugaugaagcgaucagagccgugcuguguccucccccugucaagaagcggaaacgcaagugccuucugcucuga

SEQ ID NO: 9312 - protein, 148 aa, Artificial Sequence
  Rac1__Homo_sapiens__A4D2P2
MVDGKPVNLGLWDTAGQEDYDRLRPLSYPQTDVFLICFSLVSPASFENVRAKWYPEVRHHCPNTPIILVGTKLDLRDDKDTIEKLKEKKLTPITYPQGLAMAKEIGAVKYLECSALTQRGLKTVFDEAIRAVLCPPPVKKRKRKCLLL

SEQ ID NO: 9313 - RNA, 447 nt, Artificial Sequence
  Rac1__Homo_sapiens__EAL23720
augguagauggaaaaccggugaaucugggcuuaugggauacagcuggacaagaagauuaugacagauuacgcccccuauccuauccgcaaacagauguguucuuaauuugcuuuucccuugugaguccugcaucauuugaaaauguccgugcaaagugguauccugaggugcggcaccacugucccaacacucccaucauccuagugggaacuaaacuugaucuuagggaugauaaagacacgaucgagaaacugaaggagaagaagcugacucccaucaccuauccgcagggucuagccauggcuaaggagauuggugcuguaaaauaccuggagugcucggcgcucacacagcgaggccucaagacaguguuugacgaagcgauccgagcaguccucugcccgccucccgugaagaagaggaagagaaaaugccugcuguuguaa

SEQ ID NO: 9314 - RNA, 447 nt, Artificial Sequence
  derived and/or modified sequence opt1 from Rac1__Homo_sapiens__EAL23720
augguggacggcaagcccgucaaccuggggcucugggacaccgccggccaggaggacuacgaccgccugcggccccugagcuacccccagaccgacguguuccucaucugcuucucccuggugagccccgccuccuucgagaacguccgcgcgaagugguaccccgaggugcggcaccacugcccgaacacgcccaucauccugguggggaccaagcucgaccugcgcgacgacaaggacaccaucgagaagcugaaggagaagaagcucacccccaucacguacccccagggccuggccauggccaaggagaucggggccgucaaguaccuggagugcagcgcccucacccagcggggccugaagaccguguucgacgaggcgauccgcgccgugcugugcccgccgcccgucaagaagcggaagcgcaagugccuccugcuguga

SEQ ID NO: 9315 - RNA, 447 nt, Artificial Sequence
  derived and/or modified sequence opt2 from Rac1__Homo_sapiens__EAL23720
auggucgacggcaagcccgucaaccucggccucugggacaccgccggccaggaggacuacgaccgccuccgcccccucuccuacccccagaccgacgucuuccucaucugcuucucccucgucucccccgccuccuucgagaacguccgcgccaagugguaccccgagguccgccaccacugccccaacacccccaucauccucgucggcaccaagcucgaccuccgcgacgacaaggacaccaucgagaagcucaaggagaagaagcucacccccaucaccuacccccagggccucgccauggccaaggagaucggcgccgucaaguaccucgagugcuccgcccucacccagcgcggccucaagaccgucuucgacgaggccauccgcgccguccucugccccccccccgucaagaagcgcaagcgcaagugccuccuccucuga

SEQ ID NO: 9316 - RNA, 447 nt, Artificial Sequence
  derived and/or modified sequence opt3 from Rac1__Homo_sapiens__EAL23720
augguggacggcaagcccgucaaccuggggcucugggauaccgccggacaggaggacuacgauagacuuaggccucugagcuauccacaaacagacguuuucuugaucugcuuuuccuuagugucuccggcuucauucgaaaauguacgggcaaaaugguaccccgaggugcgccaccauuguccuaacacuccaauuauacuggucgguacgaagcuagaucuccgagacgauaaagacaccaucgaaaagcugaaagagaagaaacuuacacccauuacuuauccucagggccuggccauggcgaaggaaaucggggcugugaaguacuuggagugcagugcccucacccagcguggacugaaaacaguuuuugaugaggcaauuagagccgugcuguguccacccccugucaagaaaaggaagcggaagugccucuuacuguga

SEQ ID NO: 9317 - RNA, 447 nt, Artificial Sequence
  derived and/or modified sequence opt4 from Rac1__Homo_sapiens__EAL23720
augguggacggcaagcccgugaaccugggccugugggacaccgccggccaggaggacuacgacagacugagaccccugagcuacccccagaccgacguguuccugaucugcuucagccuggugagccccgccagcuucgagaacgugagagccaagugguaccccgaggugagacaccacugccccaacacccccaucauccuggugggcaccaagcuggaccugagagacgacaaggacaccaucgagaagcugaaggagaagaagcugacccccaucaccuacccccagggccuggccauggccaaggagaucggcgccgugaaguaccuggagugcagcgcccugacccagagaggccugaagaccguguucgacgaggccaucagagccgugcugugccccccccccgugaagaagagaaagagaaagugccugcugcuguga

SEQ ID NO: 9318 - RNA, 447 nt, Artificial Sequence
  derived and/or modified sequence opt5 from Rac1__Homo_sapiens__EAL23720
augguggacggcaagcccgucaaccuggggcucugggauaccgccggacaggaggacuacgauagacugcggccucuuagcuauccgcaaacagacguuuuccugaucugcuuuucccucgugucucccgcuagcuucgaaaaugugcgcgccaaaugguacccugaggucagacaccauugucccaacacgccuauuauccuggugggcaccaaacuugaucugcgggacgauaaggacacaauugaaaagcucaaagagaagaagcugacccccaucacauauccucaggggcuggcgauggcuaaagaaauuggagccguuaaguaccucgagugcuccgcccugacccagcgcggccuuaaaacaguguuugaugaggcuaucagagccguccuguguccgcccccugugaagaaacggaagcgcaagugccuccugcuuuga

SEQ ID NO: 9319 - protein, 192 aa, Artificial Sequence; identical to SEQ ID NO: 9305
  Rac1__Homo_sapiens__P63000

SEQ ID NO: 9320 - RNA, 579 nt, Artificial Sequence; identical to SEQ ID NO: 9306
  Rac1__Homo_sapiens__AAA36537

SEQ ID NO: 9321 - RNA, 579 nt, Artificial Sequence; identical to SEQ ID NO: 9307
  derived and/or modified sequence opt1 from Rac1__Homo_sapiens__AAA36537

SEQ ID NO: 9322 - RNA, 579 nt, Artificial Sequence; identical to SEQ ID NO: 9308
  derived and/or modified sequence opt2 from Rac1__Homo_sapiens__AAA36537

SEQ ID NO: 9323 - RNA, 579 nt, Artificial Sequence; identical to SEQ ID NO: 9309
  derived and/or modified sequence opt3 from Rac1__Homo_sapiens__AAA36537

SEQ ID NO: 9324 - RNA, 579 nt, Artificial Sequence; identical to SEQ ID NO: 9310
  derived and/or modified sequence opt4 from Rac1__Homo_sapiens__AAA36537

SEQ ID NO: 9325 - RNA, 579 nt, Artificial Sequence; identical to SEQ ID NO: 9311
  derived and/or modified sequence opt5 from Rac1__Homo_sapiens__AAA36537

SEQ ID NO: 9326 - protein, 156 aa, Artificial Sequence
  Rac1__Homo_sapiens__W0UV93
MALEKSLVRLLLLVLILLVLGWVQPSLGKESRAKKFQRQHMDSDSSPSSSSTYCNQMMRRRNMTQGRCKPVNTFVHEPLVDVQNVCFQEKVTCKNGQGNCYKSNSSMHITDCRLTNGSRYPNCAYRTSPKERHIIVACEGSPYVPVHFDASVEDST

SEQ ID NO: 9327 - RNA, 471 nt, Artificial Sequence
  Rac1__Homo_sapiens__CDG31913
auggcucuggagaagucucuuguccggcuccuucugcuuguccugauacugcuggugcugggcuggguccagccuucccugggcaaggaaucccgggccaagaaauuccagcggcagcauauggacucagacaguucccccagcagcagcuccaccuacuguaaccaaaugaugaggcgccggaauaugacacaggggcggugcaaaccagugaacaccuuugugcacgagccccugguagauguccagaaugucuguuuccaggaaaaggucaccugcaagaacgggcagggcaacugcuacaagagcaacuccagcaugcacaucacagacugccgccugacaaacggcuccagguaccccaacugugcauaccggaccagcccgaaggagagacacaucauuguggccugugaagggagcccauaugugccaguccacuuugaugcuucuguggaggacucuaccuaa

SEQ ID NO: 9328 - RNA, 471 nt, Artificial Sequence
  derived and/or modified sequence opt1 from Rac1__Homo_sapiens__CDG31913
auggcccuggagaagucccucgugcgccugcugcuccugguccugauccuccuggugcugggcugggugcagcccagccucgggaaggagagccgggccaagaaguuccagcgccagcacauggacuccgacagcuccccgagcuccagcuccaccuacugcaaccagaugaugcggcgccggaacaugacccagggccgcugcaagcccgucaacacguucgugcacgagccccugguggacguccagaacgugugcuuccaggagaaggugaccugcaagaacgggcagggcaacugcuacaagagcaacuccagcaugcacaucaccgacugccggcugaccaacgggucccgcuaccccaacugcgcguaccggacgagcccgaaggagcgccacaucaucgucgccugcgagggcucccccuacgugcccgugcacuucgacgccagcgucgaggacuccaccuga

SEQ ID NO: 9329 - RNA, 471 nt, Artificial Sequence
  derived and/or modified sequence opt2 from Rac1__Homo_sapiens__CDG31913
auggcccucgagaagucccucguccgccuccuccuccucguccucauccuccucguccucggcuggguccagcccucccucggcaaggagucccgcgccaagaaguuccagcgccagcacauggacuccgacuccucccccuccuccuccuccaccuacugcaaccagaugaugcgccgccgcaacaugacccagggccgcugcaagcccgucaacaccuucguccacgagccccucgucgacguccagaacgucugcuuccaggagaaggucaccugcaagaacggccagggcaacugcuacaaguccaacuccuccaugcacaucaccgacugccgccucaccaacggcucccgcuaccccaacugcgccuaccgcaccucccccaaggagcgccacaucaucgucgccugcgagggcucccccuacguccccguccacuucgacgccuccgucgaggacuccaccuga

SEQ ID NO: 9330 - RNA, 471 nt, Artificial Sequence
  derived and/or modified sequence opt3 from Rac1__Homo_sapiens__CDG31913
auggcccuggaaaagagccucgugagacuucuguuguuaguccugauccuacucguucugggcugggugcagcccucccuugggaaagagucuagggcuaagaaauuccaacggcagcacauggacucagauaguagcccuuccucuucgucaaccuacugcaaccagaugaugcgccgacguaauaugacacagggaagauguaagccaguaaacacuuuugugcaugagccgcuggucgacgugcaaaauguuugcuuccaggaaaaagugacguguaagaacggucagggcaauugcuauaagagcaacaguuccaugcacauuaccgauuguagguugacaaaugggucucgguaccccaacugcgcauaucgcacuagcccuaaagagagacauauaaucgucgccugugaaggauccccauacgugcccguacacuuugacgcgucaguugaggauaguaccuga

SEQ ID NO: 9331 - RNA, 471 nt, Artificial Sequence
  derived and/or modified sequence opt4 from Rac1__Homo_sapiens__CDG31913
auggcccuggagaagagccuggugagacugcugcugcuggugcugauccugcuggugcugggcugggugcagcccagccugggcaaggagagcagagccaagaaguuccagagacagcacauggacagcgacagcagccccagcagcagcagcaccuacugcaaccagaugaugagaagaagaaacaugacccagggcagaugcaagcccgugaacaccuucgugcacgagccccugguggacgugcagaacgugugcuuccaggagaaggugaccugcaagaacggccagggcaacugcuacaagagcaacagcagcaugcacaucaccgacugcagacugaccaacggcagcagauaccccaacugcgccuacagaaccagccccaaggagagacacaucaucguggccugcgagggcagccccuacgugcccgugcacuucgacgccagcguggaggacagcaccuga

SEQ ID NO: 9332 - RNA, 471 nt, Artificial Sequence
  derived and/or modified sequence opt5 from Rac1__Homo_sapiens__CDG31913
auggcccuggaaaagagccucgugagacugcuucugcucguccugauccuucugguucucggcugggugcagcccucccuggggaaagagucucgggcuaagaaauuccaacgccagcacauggacagcgauuccucuccuagcuccucuagcaccuacugcaaccagaugaugagacggcgcaauaugacacagggaagauguaagccggugaacacguuuguccaugagccccugguggacguucaaaaugugugcuuccaggaaaaagucaccuguaagaacggccaggggaauugcuauaaguccaacagcucuaugcacauuacagauugucggcucaccaauggaucccgcuacccuaacugcgccuauagaacaagccccaaagagcggcauaucauuguggcgugugaaggcucuccuuacguucccgugcacuuugacgcuuccgucgaggauagcaccuga

SEQ ID NO: 9333 - protein, 193 aa, Artificial Sequence
  RhoA__Homo_sapiens__A0A024R324
MAAIRKKLVIVGDGACGKTCLLIVFSKDQFPEVYVPTVFENYVADIEVDGKQVELALWDTAGQEDYDRLRPLSYPDTDVILMCFSIDSPDSLENIPEKWTPEVKHFCPNVPIILVGNKKDLRNDEHTRRELAKMKQEPVKPEEGRDMANRIGAFGYMECSAKTKDGVREVFEMATRAALQARRGKKKSGCLVL

SEQ ID NO: 9334 - RNA, 582 nt, Artificial Sequence
  RhoA__Homo_sapiens__EAW64978
auggcugccauccggaagaaacuggugauuguuggugauggagccuguggaaagacaugcuugcucauagucuucagcaaggaccaguucccagagguguaugugcccacaguguuugagaacuauguggcagauaucgagguggauggaaagcagguagaguuggcuuugugggacacagcugggcaggaagauuaugaucgccugaggccccucuccuacccagauaccgauguuauacugauguguuuuuccaucgacagcccugauaguuuagaaaacaucccagaaaaguggaccccagaagucaagcauuucugucccaacgugcccaucauccugguugggaauaagaaggaucuucggaaugaugagcacacaaggcgggagcuagccaagaugaagcaggagccggugaaaccugaagaaggcagagauauggcaaacaggauuggcgcuuuuggguacauggaguguucagcaaagaccaaagauggagugagagagguuuuugaaauggcuacgagagcugcucugcaagcuagacgugggaagaaaaaaucugggugccuugucuuguga

SEQ ID NO: 9335 - RNA, 582 nt, Artificial Sequence
  derived and/or modified sequence opt1 from RhoA__Homo_sapiens__EAW64978
auggccgccauccgcaagaagcuggugaucgucggcgacggggcgugcggcaagaccugccuccugaucguguucagcaaggaccaguuccccgagguguacgucccgaccguguucgagaacuacguggccgacaucgaggucgacgggaagcaggucgagcuggcccucugggacacggccggccaggaggacuacgaccggcugcgcccccugagcuaccccgacaccgacgugauccucaugugcuucagcaucgacucccccgacagccuggagaacaucccggagaaguggacccccgaggugaagcacuucugccccaacgugcccaucauccugguggggaacaagaaggaccuccggaacgacgagcacacccgccgggagcuggccaagaugaagcaggagccggucaagcccgaggagggccgcgacauggcgaaccggaucggcgccuucggguacauggagugcuccgccaagacgaaggacggcgugcgcgagguguucgagauggccacccgggcggcccugcaggcccgccgggggaagaagaaguccggcugccucguccuguga

SEQ ID NO: 9336 - RNA, 582 nt, Artificial Sequence
  derived and/or modified sequence opt2 from RhoA__Homo_sapiens__EAW64978
auggccgccauccgcaagaagcucgucaucgucggcgacggcgccugcggcaagaccugccuccucaucgucuucuccaaggaccaguuccccgaggucuacguccccaccgucuucgagaacuacgucgccgacaucgaggucgacggcaagcaggucgagcucgcccucugggacaccgccggccaggaggacuacgaccgccuccgcccccucuccuaccccgacaccgacgucauccucaugugcuucuccaucgacucccccgacucccucgagaacauccccgagaaguggacccccgaggucaagcacuucugccccaacguccccaucauccucgucggcaacaagaaggaccuccgcaacgacgagcacacccgccgcgagcucgccaagaugaagcaggagcccgucaagcccgaggagggccgcgacauggccaaccgcaucggcgccuucggcuacauggagugcuccgccaagaccaaggacggcguccgcgaggucuucgagauggccacccgcgccgcccuccaggcccgccgcggcaagaagaaguccggcugccucguccucuga

SEQ ID NO: 9337 - RNA, 582 nt, Artificial Sequence
  derived and/or modified sequence opt3 from RhoA__Homo_sapiens__EAW64978
auggccgcuaucagaaagaaacuggugauugucggcgacggggcaugcggaaagaccugucuccuuauaguuuucagcaaagaucaguuucccgagguguacguaccuacaguguucgaaaacuaugucgccgacaucgagguggaugguaagcaaguugaacuggcguugugggacacugcuggccaggaggauuacgacagguuacggccacuguccuauccggauacggacgugauucuaaugugcuuuucuaucgauucacccgacagucucgaaaauauuccugagaaauggaccccagaggucaagcacuucugucccaacgugccuaucauacugguagggaauaagaaagaucuucgcaacgacgaacauacacgacgugagcuggccaagaugaaacaggaaccaguuaagcccgaggagggaagagauauggcaaauaggaucggcgccuuugguuacauggaaugcagcgcuaaaacuaaggacggggugcgggaggucuucgaaauggcaacccgcgccgcuuugcaggccagaaggggaaagaaaaaguccggcugucucgugcuguga

SEQ ID NO: 9338 - RNA, 582 nt, Artificial Sequence
  derived and/or modified sequence opt4 from RhoA__Homo_sapiens__EAW64978
auggccgccaucagaaagaagcuggugaucgugggcgacggcgccugcggcaagaccugccugcugaucguguucagcaaggaccaguuccccgagguguacgugcccaccguguucgagaacuacguggccgacaucgagguggacggcaagcagguggagcuggcccugugggacaccgccggccaggaggacuacgacagacugagaccccugagcuaccccgacaccgacgugauccugaugugcuucagcaucgacagccccgacagccuggagaacauccccgagaaguggacccccgaggugaagcacuucugccccaacgugcccaucauccuggugggcaacaagaaggaccugagaaacgacgagcacaccagaagagagcuggccaagaugaagcaggagcccgugaagcccgaggagggcagagacauggccaacagaaucggcgccuucggcuacauggagugcagcgccaagaccaaggacggcgugagagagguguucgagauggccaccagagccgcccugcaggccagaagaggcaagaagaagagcggcugccuggugcuguga

SEQ ID NO: 9339 - RNA, 582 nt, Artificial Sequence
  derived and/or modified sequence opt5 from RhoA__Homo_sapiens__EAW64978
auggccgcuaucagaaagaaacuggugauugucggcgacggggccugcggaaagaccugucuccugaucguuuucagcaaagaucaguuucccgagguguacgugccuacagucuucgaaaacuauguggcggacauugagguugauggcaagcaaguggaacuugcucugugggacacggccgggcaggaggauuacgaccggcuccgcccgcuguccuaucccgauaccgacgucauccuuaugugcuuuucuauugauagcccugacucccuggaaaauauccccgagaaauggacaccugaggugaagcacuucugucccaacguuccuaucauucucgugggaaauaagaaagaucugagaaacgacgaacauacccggcgcgagcuggccaagaugaaacaggaaccggucaagcccgaggagggcagagauauggcuaaucggaucggggccuuuggauacauggaaugcucugcuaaaacaaaggacggcgugcgcgagguguucgaaauggccaccagagcggcccuccaggcucggcgcggcaagaaaaagagcgggugucugguccuuuga

SEQ ID NO: 9340 - protein, 193 aa, Artificial Sequence; identical to SEQ ID NO: 9333
  RhoA__Homo_sapiens__P61586

SEQ ID NO: 9341 - RNA, 582 nt, Artificial Sequence
  RhoA__Homo_sapiens__AAC33178
auggcugccauccggaagaaacuggugauuguuggugauggagccuguggaaagacaugcuugcucauagucuucagcaaggaccaguucccagagguguaugugcccacaguguuugagaacuauguggcagauaucgagguggauggaaagcagguagaguuggcuuugugggacacagcugggcaggaagauuaugaucgccugaggccccucuccuacccagauaccgauguuauacugauguguuuuuccaucgacagcccugauaguuuagaaaacaucccagaaaaguggaccccagaagucaagcauuucugucccaacgugcccaucauccugguugggaauaagaaggaucuucggaaugaugagcacacaaggcgggagcuagccaagaugaagcaggagccggugaaaccugaagaaggcagagauauggcaaacaggauuggcgcuuuuggguacauggaguguucagcaaagaccaaagauggagugagagagguuuuugaaauggcuacgagagcugcucugcaagcuagacgugggaagaaaaaaucugguugccuugucuuguga

SEQ ID NO: 9342 - RNA, 582 nt, Artificial Sequence; identical to SEQ ID NO: 9335
  derived and/or modified sequence opt1 from RhoA__Homo_sapiens__AAC33178

SEQ ID NO: 9343 - RNA, 582 nt, Artificial Sequence; identical to SEQ ID NO: 9336
  derived and/or modified sequence opt2 from RhoA__Homo_sapiens__AAC33178

SEQ ID NO: 9344 - RNA, 582 nt, Artificial Sequence; identical to SEQ ID NO: 9337
  derived and/or modified sequence opt3 from RhoA__Homo_sapiens__AAC33178

SEQ ID NO: 9345 - RNA, 582 nt, Artificial Sequence; identical to SEQ ID NO: 9338
  derived and/or modified sequence opt4 from RhoA__Homo_sapiens__AAC33178

SEQ ID NO: 9346 - RNA, 582 nt, Artificial Sequence; identical to SEQ ID NO: 9339
  derived and/or modified sequence opt5 from RhoA__Homo_sapiens__AAC33178

SEQ ID NO: 9347 - protein, 925 aa, Artificial Sequence
  RIG-I__Homo_sapiens__O95786
MTTEQRRSLQAFQDYIRKTLDPTYILSYMAPWFREEEVQYIQAEKNNKGPMEAATLFLKFLLELQEEGWFRGFLDALDHAGYSGLYEAIESWDFKKIEKLEEYRLLLKRLQPEFKTRIIPTDIISDLSECLINQECEEILQICSTKGMMAGAEKLVECLLRSDKENWPKTLKLALEKERNKFSELWIVEKGIKDVETEDLEDKMETSDIQIFYQEDPECQNLSENSCPPSEVSDTNLYSPFKPRNYQLELALPAMKGKNTIICAPTGCGKTFVSLLICEHHLKKFPQGQKGKVVFFANQIPVYEQQKSVFSKYFERHGYRVTGISGATAENVPVEQIVENNDIIILTPQILVNNLKKGTIPSLSIFTLMIFDECHNTSKQHPYNMIMFNYLDQKLGGSSGPLPQVIGLTASVGVGDAKNTDEALDYICKLCASLDASVIATVKHNLEELEQVVYKPQKFFRKVESRISDKFKYIIAQLMRDTESLAKRICKDLENLSQIQNREFGTQKYEQWIVTVQKACMVFQMPDKDEESRICKALFLYTSHLRKYNDALIISEHARMKDALDYLKDFFSNVRAAGFDEIEQDLTQRFEEKLQELESVSRDPSNENPKLEDLCFILQEEYHLNPETITILFVKTRALVDALKNWIEGNPKLSFLKPGILTGRGKTNQNTGMTLPAQKCILDAFKASGDHNILIATSVADEGIDIAQCNLVILYEYVGNVIKMIQTRGRGRARGSKCFLLTSNAGVIEKEQINMYKEKMMNDSILRLQTWDEAVFREKILHIQTHEKFIRDSQEKPKPVPDKENKKLLCRKCKALACYTADVRVIEECHYTVLGDAFKECFVSRPHPKPKQFSSFEKRAKIFCARQNCSHDWGIHVKYKTFEIPVIKIESFVVEDIATGVQTLYSKWKDFHFEKIPFDPAEMSK

SEQ ID NO: 9348 - RNA, 2778 nt, Artificial Sequence
  RIG-I__Homo_sapiens__AAI32787
augaccaccgagcagcgacgcagccugcaagccuuccaggauuauauccggaagacccuggacccuaccuacauccugagcuacauggcccccugguuuagggaggaagaggugcaguauauucaggcugagaaaaacaacaagggcccaauggaggcugccacacuuuuucucaaguuccuguuggagcuccaggaggaaggcugguuccguggcuuuuuggaugcccuagaccaugcagguuauucuggacuuuaugaagccauugaaaguugggauuucaaaaaaauugaaaaguuggaggaguauagauuacuuuuaaaacguuuacaaccagaauuuaaaaccagaauuaucccaaccgauaucauuucugaucugucugaauguuuaauuaaucaggaaugugaagaaauucuacagauuugcucuacuaaggggaugauggcaggugcagagaaauugguggaaugccuucucagaucagacaaggaaaacuggcccaaaacuuugaaacuugcuuuggagaaagaaaggaacaaguucagugaacuguggauuguagagaaagguauaaaagauguugaaacagaagaucuugaggauaagauggaaacuucugacauacagauuuucuaccaagaagauccagaaugccagaaucuuagugagaauucauguccaccuucagaagugucugauacaaacuuguacagcccauuuaaaccaagaaauuaccaauuagagcuugcuuugccugcuaugaaaggaaaaaacacaauaauaugugcuccuacagguuguggaaaaaccuuuguuucacugcuuauaugugaacaucaucuuaaaaaauucccacaaggacaaaaggggaaaguugucuuuuuugcgaaucagaucccaguguaugaacagcagaaaucuguauucucaaaauacuuugaaagacauggguauagaguuacaggcauuucuggagcaacagcugagaaugucccaguggaacagauuguugagaacaaugacaucaucauuuuaacuccacagauucuugugaacaaccuuaaaaagggaacgauuccaucacuauccaucuuuacuuugaugauauuugaugaaugccacaacacuaguaaacaacacccguacaauaugaucauguuuaauuaucuagaucagaaacuuggaggaucuucaggcccacugccccaggucauugggcugacugccucgguugguguuggggaugccaaaaacacagaugaagccuuggauuauaucugcaagcugugugcuucucuugaugcgucagugauagcaacagucaaacacaaucuggaggaacuggagcaaguuguuuauaagccccagaaguuuuucaggaaaguggaaucacggauuagcgacaaauuuaaauacaucauagcucagcugaugagggacacagagagucuggcaaagagaaucugcaaagaccucgaaaacuuaucucaaauucaaaauagggaauuuggaacacagaaauaugaacaauggauuguuacaguucagaaagcaugcaugguguuccagaugccagacaaagaugaagagagcaggauuuguaaagcccuguuuuuauacacuucacauuugcggaaauauaaugaugcccucauuaucagugagcaugcacgaaugaaagaugcucuggauuacuugaaagacuucuucagcaauguccgagcagcaggauucgaugagauugagcaagaucuuacucagagauuugaagaaaagcugcaggaacuagaaaguguuuccagggaucccagcaaugagaauccuaaacuugaagaccucugcuucaucuuacaagaagaguaccacuuaaacccagagacaauaacaauucucuuugugaaaaccagagcacuuguggacgcuuuaaaaaauuggauugaaggaaauccuaaacucaguuuucuaaaaccuggcauauugacuggacguggcaaaacaaaucagaacacaggaaugacccucccggcacagaaguguauauuggaugcauucaaagccaguggagaucacaauauucugauugccaccucaguugcugaugaaggcauugacauugcacagugcaaucuugucauccuuuaugaguaugugggcaaugucaucaaaaugauccaaaccagaggcagaggaagagcaagagguagcaagugcuuccuucugacuaguaaugcugguguaauugaaaaagaacaaauaaacauguacaaagaaaaaaugaugaaugacucuauuuuacgccuucagacaugggacgaagcaguauuuagggaaaagauucugcauauacagacucaugaaaaauucaucagagauagucaagaaaaaccaaaaccuguaccugauaaggaaaauaaaaaacugcucugcagaaagugcaaagccuuggcauguuacacagcugacguaagagugauagaggaaugccauuacacugugcuuggagaugcuuuuaaggaaugcuuugugaguagaccacaucccaagccaaagcaguuuucaaguuuugaaaaaagagcaaagauauucugugcccgacagaacugcagccaugacuggggaauccaugugaaguacaagacauuugagauuccaguuauaaaaauugaaaguuuugugguggaggauauugcaacuggaguucagacacuguacucgaaguggaaggacuuucauuuugagaagauaccauuugauccagcagaaauguccaaauga

SEQ ID NO: 9349 - RNA, 2778 nt, Artificial Sequence
  derived and/or modified sequence opt1 from RIG-I__Homo_sapiens__AAI32787
augaccaccgagcagcgccggagccugcaggccuuccaggacuacauccgcaagacgcucgaccccaccuacauccuguccuacauggccccgugguuccgggaggaggaggugcaguacauccaggcggagaagaacaacaagggccccauggaggccgccacccuguuccucaaguuccugcuggagcuccaggaggaggggugguuccgcggcuuccuggacgcccuggaccacgccggguacagcggccucuacgaggcgaucgaguccugggacuucaagaagaucgagaagcuggaggaguaccggcugcuccugaagcgccugcagcccgaguucaagacccggaucauccccacggacaucaucagcgaccucuccgagugccugaucaaccaggagugcgaggagauccugcagaucugcagcaccaaggggaugauggccggcgccgagaagcucgucgagugccugcugcgcuccgacaaggagaacuggccgaagacccucaagcuggcccuggagaaggagcggaacaaguucagcgagcucuggaucguggagaagggcaucaaggacguggagaccgaggaccuggaggacaagauggagacguccgacauccagaucuucuaccaggaggaccccgagugccagaaccugagcgagaacuccugcccgcccagcgaggucuccgacaccaaccucuacagccccuucaagccccgcaacuaccagcuggagcuggcgcuccccgccaugaaggggaagaacaccaucaucugcgcccccaccggcugcgggaagacguucgugucccugcugaucugcgagcaccaccucaagaaguucccgcagggccagaaggggaagguggucuucuucgccaaccagauccccguguacgagcagcagaaguccguguucagcaaguacuucgagcggcacggcuaccgcgucaccggcaucagcggggccaccgcggagaacgugcccguggagcagaucgucgagaacaacgacaucaucauccugacgccccagauccuggugaacaaccucaagaagggcaccaucccgucccugagcaucuucacccugaugaucuucgacgagugccacaacaccagcaagcagcaccccuacaacaugaucauguucaacuaccucgaccagaagcucgggggcuccagcggcccccugccccaggugaucgggcucaccgccuccgucggcgugggggacgccaagaacacggacgaggcccuggacuacaucugcaagcugugcgccagccucgacgcguccgugaucgccaccgucaagcacaaccuggaggagcuggagcaggucguguacaagccgcagaaguucuuccggaagguggagagccgcaucuccgacaaguucaaguacaucaucgcccagcucaugcgggacaccgagagccuggccaagcgcaucugcaaggaccuggagaaccugucccagauccagaaccgggaguucggcacccagaaguacgagcaguggaucgugacggugcagaaggccugcauggucuuccagaugcccgacaaggacgaggagagccgcaucugcaaggcgcuguuccuguacaccucccaccuccggaaguacaacgacgcccugaucaucagcgagcacgcccgcaugaaggacgcccuggacuaccugaaggacuucuucuccaacgugcgggccgcgggguucgacgagaucgagcaggaccucacccagcgcuucgaggagaagcugcaggagcuggagagcgucucccgcgaccccagcaacgagaaccccaagcucgaggaccugugcuucauccugcaggaggaguaccaccucaacccggagaccaucacgauccuguucgugaagacccgggcccugguggacgcccucaagaacuggaucgagggcaaccccaagcuguccuuccugaagcccggcauccucaccgggcgcggcaagaccaaccagaacacggggaugacccugcccgcccagaagugcauccuggacgcguucaaggccagcggcgaccacaacauccucaucgccaccuccgucgccgacgaggggaucgacaucgcccagugcaaccuggugauccuguacgaguacgugggcaacgucaucaagaugauccagacccggggccgcgggcgggcgcgcggcagcaagugcuuccuccugacgagcaacgccggggugaucgagaaggagcagaucaacauguacaaggagaagaugaugaacgacuccauccugcggcuccagaccugggacgaggccguguuccgcgagaagauccugcacauccagacccacgagaaguucauccgggacagccaggagaagccgaagcccguccccgacaaggagaacaagaagcugcucugccgcaagugcaaggcccuggccugcuacaccgcggacgugcgggugaucgaggagugccacuacaccguccugggcgacgccuucaaggagugcuucgugucccgcccgcaccccaagcccaagcaguucagcuccuucgagaagcgggccaagaucuucugcgcccgccagaacugcagccacgacugggggauccacgugaaguacaagacguucgagauccccgucaucaagaucgaguccuucgugguggaggacaucgccaccggcguccagacccucuacagcaaguggaaggacuuccacuucgagaagaucccguucgaccccgcggagauguccaaguga

SEQ ID NO: 9350 - RNA, 2778 nt, Artificial Sequence
  derived and/or modified sequence opt2 from RIG-I__Homo_sapiens__AAI32787
augaccaccgagcagcgccgcucccuccaggccuuccaggacuacauccgcaagacccucgaccccaccuacauccucuccuacauggcccccugguuccgcgaggaggagguccaguacauccaggccgagaagaacaacaagggccccauggaggccgccacccucuuccucaaguuccuccucgagcuccaggaggagggcugguuccgcggcuuccucgacgcccucgaccacgccggcuacuccggccucuacgaggccaucgaguccugggacuucaagaagaucgagaagcucgaggaguaccgccuccuccucaagcgccuccagcccgaguucaagacccgcaucauccccaccgacaucaucuccgaccucuccgagugccucaucaaccaggagugcgaggagauccuccagaucugcuccaccaagggcaugauggccggcgccgagaagcucgucgagugccuccuccgcuccgacaaggagaacuggcccaagacccucaagcucgcccucgagaaggagcgcaacaaguucuccgagcucuggaucgucgagaagggcaucaaggacgucgagaccgaggaccucgaggacaagauggagaccuccgacauccagaucuucuaccaggaggaccccgagugccagaaccucuccgagaacuccugcccccccuccgaggucuccgacaccaaccucuacucccccuucaagccccgcaacuaccagcucgagcucgcccuccccgccaugaagggcaagaacaccaucaucugcgcccccaccggcugcggcaagaccuucgucucccuccucaucugcgagcaccaccucaagaaguucccccagggccagaagggcaaggucgucuucuucgccaaccagauccccgucuacgagcagcagaaguccgucuucuccaaguacuucgagcgccacggcuaccgcgucaccggcaucuccggcgccaccgccgagaacguccccgucgagcagaucgucgagaacaacgacaucaucauccucaccccccagauccucgucaacaaccucaagaagggcaccauccccucccucuccaucuucacccucaugaucuucgacgagugccacaacaccuccaagcagcaccccuacaacaugaucauguucaacuaccucgaccagaagcucggcggcuccuccggcccccucccccaggucaucggccucaccgccuccgucggcgucggcgacgccaagaacaccgacgaggcccucgacuacaucugcaagcucugcgccucccucgacgccuccgucaucgccaccgucaagcacaaccucgaggagcucgagcaggucgucuacaagccccagaaguucuuccgcaaggucgagucccgcaucuccgacaaguucaaguacaucaucgcccagcucaugcgcgacaccgagucccucgccaagcgcaucugcaaggaccucgagaaccucucccagauccagaaccgcgaguucggcacccagaaguacgagcaguggaucgucaccguccagaaggccugcauggucuuccagaugcccgacaaggacgaggagucccgcaucugcaaggcccucuuccucuacaccucccaccuccgcaaguacaacgacgcccucaucaucuccgagcacgcccgcaugaaggacgcccucgacuaccucaaggacuucuucuccaacguccgcgccgccggcuucgacgagaucgagcaggaccucacccagcgcuucgaggagaagcuccaggagcucgaguccgucucccgcgaccccuccaacgagaaccccaagcucgaggaccucugcuucauccuccaggaggaguaccaccucaaccccgagaccaucaccauccucuucgucaagacccgcgcccucgucgacgcccucaagaacuggaucgagggcaaccccaagcucuccuuccucaagcccggcauccucaccggccgcggcaagaccaaccagaacaccggcaugacccuccccgcccagaagugcauccucgacgccuucaaggccuccggcgaccacaacauccucaucgccaccuccgucgccgacgagggcaucgacaucgcccagugcaaccucgucauccucuacgaguacgucggcaacgucaucaagaugauccagacccgcggccgcggccgcgcccgcggcuccaagugcuuccuccucaccuccaacgccggcgucaucgagaaggagcagaucaacauguacaaggagaagaugaugaacgacuccauccuccgccuccagaccugggacgaggccgucuuccgcgagaagauccuccacauccagacccacgagaaguucauccgcgacucccaggagaagcccaagcccguccccgacaaggagaacaagaagcuccucugccgcaagugcaaggcccucgccugcuacaccgccgacguccgcgucaucgaggagugccacuacaccguccucggcgacgccuucaaggagugcuucgucucccgcccccaccccaagcccaagcaguucuccuccuucgagaagcgcgccaagaucuucugcgcccgccagaacugcucccacgacuggggcauccacgucaaguacaagaccuucgagauccccgucaucaagaucgaguccuucgucgucgaggacaucgccaccggcguccagacccucuacuccaaguggaaggacuuccacuucgagaagauccccuucgaccccgccgagauguccaaguga

SEQ ID NO: 9351 - RNA, 2778 nt, Artificial Sequence
  derived and/or modified sequence opt3 from RIG-I__Homo_sapiens__AAI32787
augaccacagagcagagaaggagccugcaagccuuccaggacuacauccggaagacucucgaucccacguauauucuuuccuacauggcuccuugguuucgcgaagaggaagugcaguauauacaggcagagaaaaacaauaagggcccaauggaagccgcgacccuguucuugaaauuuuuacuggagcuacaagaggaagggugguuccgaggauuucucgacgcucuggaucacgccgguuacucuggccuuuaugaggcaaucgaaucaugggacuucaagaaaauugagaagcuggaggaauaccguuugcuccugaagagacugcagccggaguuuaaaacaaggaucauucccacugauaucauaagugaccucagcgaaugcuuaaucaaccaggagugugaagagauucugcagaucugcuccaccaaggggaugauggccggagcugagaaacuugucgaauguuugcugcggucugauaaggagaauuggccuaaaacacuaaagcucgcacuggaaaaggagcgcaacaaauucucggaacuuuggauuguugagaagggcaucaaagacguggagaccgaagaucuggaggacaagauggaaacuucagauauacaaaucuuuuaucaggaggacccagaaugccagaauuugagcgagaacaguugucccccuuccgagguaucugauacaaaucucuacagcccauucaaacccagaaacuaccagcuggaauuagcccugccugcuaugaaggguaaaaauaccauuauuugcgccccaacgggguguggaaagacuuuugugucccuccuuaucugcgagcaucaccugaagaaauucccgcaaggccagaagggcaaagucguguuuuucgcgaaccagauccccguuuaugaacaacagaagucaguguucaguaaauacuuugagaggcauggguaucgggucaccggaauuagcggugcaacagccgagaaugugccuguagaacagauaguugagaacaaugacaucauuaucuugacuccacagauacuggugaacaaucugaagaagggcaccauucccucucucuccaucuucacacugaugaucuuugacgaaugucacaacaccucaaaacaacauccuuacaacaugauuauguucaauuaucuugaucagaagcuagggggaagcaguggcccauugccccaggucaucggucucacggcuucugugggggugggagacgccaaaaacacugaugaggcacuggacuacauuugcaaguuaugugcuucccuggaugccagcgucauagcgacaguuaaacacaaucuagaggagcucgaacaggugguauauaagccgcaaaaguuuuuccgcaaaguggaaucgcgaaucucugacaaguuuaaauacauuaucgcccagcugaugagagauaccgagucccuugcaaagaggaucugcaaagacuuggaaaaccugucacagauucagaaucgggaguucggcacucaaaaguacgaacaguggauagucacagugcagaaggcuugcaugguuuuucagaugccugauaaagacgaggagagucguaucuguaaggcccucuuccuguauaccagccaccuucgcaaauacaacgaugcucugauuaucuccgaacaugccagaaugaaggacgcauuggacuaucucaaagacuuuuucucuaaugugagggccgcuggcuuugaugagauugaacaagaucugacgcagcgguucgaggaaaaguuacaggagcuggagagcgucucacgagaccccaguaacgaaaauccaaaacuagaggaucucugcuucauccugcaagaagaguaccaccuuaacccugagaccauaacaaucuuguuugugaagacucgcgcgcugguagacgcacucaagaauuggauugaagggaaccccaaacuguccuucuuaaagccaggaauccugaccgguagaggcaaaacaaaucagaacacugggaugacccuucccgcccagaaguguauuuuggaugcuuuuaaagccagcggagaccauaauauccucauagcaacaucuguugccgaugagggcauugacaucgcucagugcaaccuggugauucuauaugaauacgucgguaacgugaucaagaugauacaaaccagggggcggggccgcgccagaggaucaaaguguuuccugcucacgaguaaugcaggcgucaucgagaaagaacagauuaacauguauaaggagaaaaugaugaaugauagcauccugaggcuucagacuugggacgaggcgguguuucgugaaaagauuuugcacauccagacacacgagaaauucauacgggauucccaagaaaagccuaagccaguuccggacaaagagaacaagaaacuguuaugccgaaaguguaaagcucucgccugcuacaccgcagacgugagaguaauugaagagugucauuacacuguccugggggaugccuuuaaggagugcuucgugucuaggccccacccuaagccaaaacaguuuucgagcuucgaaaagcgcgcuaaaaucuuuugugcccggcagaauugcucccaugacuggggaauccacguuaaguauaaaaccuucgagauucccgugaucaagauugaaucauuugucguggaggauauagcaacagguguacagacccuuuacaguaaauggaaggacuuccauuucgaaaagaucccuuuugauccagcugagaugucuaaauga

SEQ ID NO: 9352 - RNA, 2778 nt, Artificial Sequence
  derived and/or modified sequence opt4 from RIG-I__Homo_sapiens__AAI32787
augaccaccgagcagagaagaagccugcaggccuuccaggacuacaucagaaagacccuggaccccaccuacauccugagcuacauggcccccugguucagagaggaggaggugcaguacauccaggccgagaagaacaacaagggccccauggaggccgccacccuguuccugaaguuccugcuggagcugcaggaggagggcugguucagaggcuuccuggacgcccuggaccacgccggcuacagcggccuguacgaggccaucgagagcugggacuucaagaagaucgagaagcuggaggaguacagacugcugcugaagagacugcagcccgaguucaagaccagaaucauccccaccgacaucaucagcgaccugagcgagugccugaucaaccaggagugcgaggagauccugcagaucugcagcaccaagggcaugauggccggcgccgagaagcugguggagugccugcugagaagcgacaaggagaacuggcccaagacccugaagcuggcccuggagaaggagagaaacaaguucagcgagcuguggaucguggagaagggcaucaaggacguggagaccgaggaccuggaggacaagauggagaccagcgacauccagaucuucuaccaggaggaccccgagugccagaaccugagcgagaacagcugcccccccagcgaggugagcgacaccaaccuguacagccccuucaagcccagaaacuaccagcuggagcuggcccugcccgccaugaagggcaagaacaccaucaucugcgcccccaccggcugcggcaagaccuucgugagccugcugaucugcgagcaccaccugaagaaguucccccagggccagaagggcaaggugguguucuucgccaaccagauccccguguacgagcagcagaagagcguguucagcaaguacuucgagagacacggcuacagagugaccggcaucagcggcgccaccgccgagaacgugcccguggagcagaucguggagaacaacgacaucaucauccugaccccccagauccuggugaacaaccugaagaagggcaccauccccagccugagcaucuucacccugaugaucuucgacgagugccacaacaccagcaagcagcaccccuacaacaugaucauguucaacuaccuggaccagaagcugggcggcagcagcggcccccugccccaggugaucggccugaccgccagcgugggcgugggcgacgccaagaacaccgacgaggcccuggacuacaucugcaagcugugcgccagccuggacgccagcgugaucgccaccgugaagcacaaccuggaggagcuggagcaggugguguacaagccccagaaguucuucagaaagguggagagcagaaucagcgacaaguucaaguacaucaucgcccagcugaugagagacaccgagagccuggccaagagaaucugcaaggaccuggagaaccugagccagauccagaacagagaguucggcacccagaaguacgagcaguggaucgugaccgugcagaaggccugcaugguguuccagaugcccgacaaggacgaggagagcagaaucugcaaggcccuguuccuguacaccagccaccugagaaaguacaacgacgcccugaucaucagcgagcacgccagaaugaaggacgcccuggacuaccugaaggacuucuucagcaacgugagagccgccggcuucgacgagaucgagcaggaccugacccagagauucgaggagaagcugcaggagcuggagagcgugagcagagaccccagcaacgagaaccccaagcuggaggaccugugcuucauccugcaggaggaguaccaccugaaccccgagaccaucaccauccuguucgugaagaccagagcccugguggacgcccugaagaacuggaucgagggcaaccccaagcugagcuuccugaagcccggcauccugaccggcagaggcaagaccaaccagaacaccggcaugacccugcccgcccagaagugcauccuggacgccuucaaggccagcggcgaccacaacauccugaucgccaccagcguggccgacgagggcaucgacaucgcccagugcaaccuggugauccuguacgaguacgugggcaacgugaucaagaugauccagaccagaggcagaggcagagccagaggcagcaagugcuuccugcugaccagcaacgccggcgugaucgagaaggagcagaucaacauguacaaggagaagaugaugaacgacagcauccugagacugcagaccugggacgaggccguguucagagagaagauccugcacauccagacccacgagaaguucaucagagacagccaggagaagcccaagcccgugcccgacaaggagaacaagaagcugcugugcagaaagugcaaggcccuggccugcuacaccgccgacgugagagugaucgaggagugccacuacaccgugcugggcgacgccuucaaggagugcuucgugagcagaccccaccccaagcccaagcaguucagcagcuucgagaagagagccaagaucuucugcgccagacagaacugcagccacgacuggggcauccacgugaaguacaagaccuucgagauccccgugaucaagaucgagagcuucgugguggaggacaucgccaccggcgugcagacccuguacagcaaguggaaggacuuccacuucgagaagauccccuucgaccccgccgagaugagcaaguga

SEQ ID NO: 9353 - RNA, 2778 nt, Artificial Sequence
  derived and/or modified sequence opt5 from RIG-I__Homo_sapiens__AAI32787
augaccacagagcagagacggagccugcaagccuuccaggacuacauccgcaagacgcucgaucccaccuauauucuguccuacauggcuccuugguuuagagaagaggaagugcaguauauccaggccgagaaaaacaauaagggcccgauggaagcggcuacacuuuuccugaaauuucuccuggagcuucaagaggaagggugguuccggggauuucuggacgcccucgaucacgccggcuacucugggcuguaugaggcuauugaaagcugggacuucaagaaaaucgagaagcuggaggaauaccgccuccugcuuaagagacugcagcccgaguuuaaaacccggauuaucccuacagauaucauuuccgaccucucugaaugccugaucaaccaggagugugaagagauucuucagaucugcagcaccaagggaaugauggccggcgcugagaaacuggucgaaugucuccugcgcuccgauaaggagaauuggcccaaaacacugaagcucgcccuggaaaaggagagaaacaaauucucugaacuuuggauuguugagaaggggaucaaagacguggagaccgaagaucuggaggacaagauggaaacgagcgauauucaaaucuuuuaucaggaggacccugaaugccagaaucucuccgagaacagcugucccccuucugagguguccgauaccaaucuguacagcccguucaaaccccggaacuaccagcuugaacuggcgcucccugccaugaaggggaaaaauacaaucauuugcgcucccaccggcuguggcaagacauuugucucucugcugaucugcgagcaucaccucaagaaauucccucaagggcagaagggaaaagugguguuuuucgccaaccagauucccguuuaugaacaacagaaguccgucuucagcaaauacuuugagcgccauggcuauagagugaccgggaucucuggagcuacggccgagaauguuccgguggaacagauugucgagaacaaugacaucaucauucugacaccucagauccuugugaacaaucugaagaagggcaccauucccucccucagcaucuucacacugaugauuuuugacgaaugucacaacaccuccaaacaacauccuuacaacaugaucauguucaauuaucuugaucagaagcugggaggaucuagcggcccccucccccaggugaucggccugaccgcguccgucgggguuggagacgccaaaaacacagaugaggcucuggacuacauuugcaagcucugugccagccuggaugcuucugugaucgccacggugaaacacaaucuugaggaacuggagcaggucguguauaagccucaaaaguuuuuccggaaaguugaaucccgcauuagcgacaaguuuaaauacaucauugcccagcucaugagagauaccgagucucuggcuaagcggaucugcaaagaccuggaaaaccuuagccagauucagaaucgcgaguucggcacacaaaaguacgaacaguggaucgugaccguccagaaggcgugcaugguguuucagaugccggauaaagacgaggaguccagaaucuguaaggcccucuuccuguauacaucucaucugcggaaauacaacgaugcucucauuaucagcgaacacgccagaaugaaggacgcccuggacuaucuuaaagacuuuuucuccaauguucgcgcugccggguuugaugagauugaacaagaucugacccagcgguucgaggaaaagcuccaggagcuggagagcgugucuagagaccccuccaacgaaaauccuaaacuggaggaucuuugcuucauccuccaagaagaguaccaccugaaccccgagacgauuacaauccuguuugucaagacccgcgcgcucguggacgcucugaagaauuggaucgaaggaaacccuaaacuuagcuuccugaagcccggcauucucaccgggcggggaaaaacaaaucagaacaccggcaugacacugccggcccagaaguguauccuggaugccuuuaaggcuucuggcgaccauaauauucuuaucgccacguccgucgcugaugaggggauugacaucgcccagugcaaccucgugauccuguaugaauacguuggaaacgugauuaaaaugauccaaaccagaggccgcgggcgggcgagaggaagcaaguguuuccugcucacauccaaugccggcgucauugagaaagaacagaucaacauguauaaggagaaaaugaugaaugauucuauucugcgccuucagaccugggacgaggcuguguuucgggaaaagauccugcacauccagacacacgagaaauucauuagagauagccaagaaaagccuaagcccguuccugacaaagagaacaagaaacuccugugccgcaaguguaaagcccuggcuugcuacaccgccgacgugcgggucaucgaagagugucauuacacggugcuuggggaugcguuuaaggagugcuucguguccagaccccacccuaagcccaaacaguuuucuagcuucgaaaagcgggccaaaaucuuuugugcucgccagaauugcucccaugacuggggcauucacguuaaguauaaaaccuucgagauuccggucaucaagauugagagcuuugugguggaagauaucgccacaggaguccagacccucuacucuaaauggaaggacuuccauuucgaaaagaucccuuuugaucccgcugagauguccaaauga

SEQ ID NO: 9354 - protein, 432 aa, Artificial Sequence
  RIG-I__Homo_sapiens__Q8IUD6
MAGLGLGSAVPVWLAEDDLGCIICQGLLDWPATLPCGHSFCRHCLEALWGARDARRWACPTCRQGAAQQPHLRKNTLLQDLADKYRRAAREIQAGSDPAHCPCPGSSSLSSAAARPRRRPELQRVAVEKSITEVAQELTELVEHLVDIVRSLQNQRPLSESGPDNELSILGKAFSSGVDLSMASPKLVTSDTAAGKIRDILHDLEEIQEKLQESVTWKEAPEAQMQGELLEAPSSSSCPLPDQSHPALRRASRFAQWAIHPTFNLKSLSCSLEVSKDSRTVTVSHRPQPYRWSCERFSTSQVLCSQALSSGKHYWEVDTRNCSHWAVGVASWEMSRDQVLGRTMDSCCVEWKGTSQLSAWHMVKETVLGSDRPGVVGIWLNLEEGKLAFYSVDNQEKLLYECTISASSPLYPAFWLYGLHPGNYLIIKQVKV

SEQ ID NO: 9355 - RNA, 1299 nt, Artificial Sequence
  RIG-I__Homo_sapiens__AAI26421
auggcgggccugggccugggcuccgccguucccguguggcuggccgaggacgaccucggcugcaucaucugccaggggcugcuggacuggcccgccacgcugcccugcggccacagcuucugccgccacugccuggaggcccuguggggcgcccgcgacgcccgccgcugggccugccccacuugccgccagggcgccgcgcagcagccgcaccugcggaagaacacgcuacugcaggaccuggccgacaaguaccgccgcgccgcacgcgagauacaggcgggcuccgacccugcccacugccccugcccgggcuccaguucccucuccagcgcggccgcgaggccccggcgccgcccggaacugcagcggguggcaguagagaagagcaucacagaaguugcucaggagcugacagagcugguggaacaucuuguagacauugucagaagccugcagaaucagaggccccuaucagaaucuggaccagacaacgaacugagcauccugggcaaggcuuuuucuucugggguggaucuuuccauggcuucuccaaagcuggugacuuccgacacagcugcagggaaaaucagagauauucuccaugaccuagaagaaauucaggaaaaauuacaagaaagcgucaccuggaaagaggcuccugaagcacaaaugcagggagaacuccuggaagccccgucuuccuccucaugcccauugccugaccagagccacccugcacucaggagagcuucucgguuugcucagugggccauccauccaaccuuuaacuugaagagccuuuccugcagccuggagguguccaaggauucccguacagugacugugucucaccgcccacaacccuaucgcuggagcugugagagguuuucuaccagccaggucuuauguucccaggcccugucuucuggaaagcauuacugggaaguggacacuaggaauugcagccacugggcaguugggguggcuuccugggagaugagccgcgaccagguccugggaaggacuauggacucuuguuguguggaauggaaggggacuagccagcucucugcauggcacauggucaaggaaacuguccuuggcucagacagaccugggguggugggcaucuggcugaaccuugaggagggaaagcuugccuucuauucaguggacaaucaggagaagcuucuguaugaguguaccaucucugccuccucuccuuuguacccugccuucuggcuguauggcuuacauccuggaaauuaccugauaauaaagcaaguaaagguguaa

SEQ ID NO: 9356 - RNA, 1299 nt, Artificial Sequence
  derived and/or modified sequence opt1 from RIG-I__Homo_sapiens__AAI26421
auggccggccuggggcucggcagcgccgugcccgucuggcuggcggaggacgaccuggggugcaucaucugccagggccuccuggacuggccggccacccugcccugcgggcacuccuucugccgccacugccucgaggcccuguggggcgcccgggacgcccgccggugggcgugcccgaccugccgccagggcgccgcccagcagccccaccuccggaagaacacgcugcugcaggaccuggccgacaaguaccgccgggcggcccgcgagauccaggccgggagcgaccccgcccacugccccugccccggcuccagcucccucagcuccgccgcggcccggccccgccggcgcccggagcugcagcggguggccguggagaaguccaucaccgaggucgcccaggagcugaccgagcucguggagcaccugguggacaucguccgcucccugcagaaccagcggccccucagcgaguccgggcccgacaacgagcugagcauccugggcaaggccuucuccagcgggguggaccucuccauggcgagccccaagcuggugaccuccgacacggccgccggcaagauccgcgacauccugcacgaccucgaggagauccaggagaagcugcaggagagcgucaccuggaaggaggccccggaggcccagaugcagggcgagcugcucgaggcgcccuccagcagcuccugcccccugcccgaccagagccacccggcccugcggcgcgccucccgguucgcccagugggccauccaccccaccuucaaccucaagagccuguccugcagccuggagguguccaaggacagccgcaccgugacggucucccaccggccccagcccuaccgcuggagcugcgagcgcuucuccaccagccaggugcucugcucccaggcgcugagcuccgggaagcacuacugggagguggacacccggaacugcagccacugggccgucggcguggccuccugggagaugagccgcgaccaggugcuggggcggaccauggacuccugcugcgucgaguggaagggcacgagccagcucagcgccuggcacauggugaaggagaccgugcugggcuccgaccgcccgggggucgugggcaucuggcugaaccucgaggaggggaagcuggcguucuacagcguggacaaccaggagaagcugcucuacgagugcaccaucuccgccagcagcccccuguaccccgccuucuggcuguacggccuccaccccgggaacuaccugaucaucaagcaggucaagguguga

SEQ ID NO: 9357 - RNA, 1299 nt, Artificial Sequence
  derived and/or modified sequence opt2 from RIG-I__Homo_sapiens__AAI26421
auggccggccucggccucggcuccgccguccccgucuggcucgccgaggacgaccucggcugcaucaucugccagggccuccucgacuggcccgccacccuccccugcggccacuccuucugccgccacugccucgaggcccucuggggcgcccgcgacgcccgccgcugggccugccccaccugccgccagggcgccgcccagcagccccaccuccgcaagaacacccuccuccaggaccucgccgacaaguaccgccgcgccgcccgcgagauccaggccggcuccgaccccgcccacugccccugccccggcuccuccucccucuccuccgccgccgcccgcccccgccgccgccccgagcuccagcgcgucgccgucgagaaguccaucaccgaggucgcccaggagcucaccgagcucgucgagcaccucgucgacaucguccgcucccuccagaaccagcgcccccucuccgaguccggccccgacaacgagcucuccauccucggcaaggccuucuccuccggcgucgaccucuccauggccucccccaagcucgucaccuccgacaccgccgccggcaagauccgcgacauccuccacgaccucgaggagauccaggagaagcuccaggaguccgucaccuggaaggaggcccccgaggcccagaugcagggcgagcuccucgaggcccccuccuccuccuccugcccccuccccgaccagucccaccccgcccuccgccgcgccucccgcuucgcccagugggccauccaccccaccuucaaccucaagucccucuccugcucccucgaggucuccaaggacucccgcaccgucaccgucucccaccgcccccagcccuaccgcugguccugcgagcgcuucuccaccucccagguccucugcucccaggcccucuccuccggcaagcacuacugggaggucgacacccgcaacugcucccacugggccgucggcgucgccuccugggagaugucccgcgaccagguccucggccgcaccauggacuccugcugcgucgaguggaagggcaccucccagcucuccgccuggcacauggucaaggagaccguccucggcuccgaccgccccggcgucgucggcaucuggcucaaccucgaggagggcaagcucgccuucuacuccgucgacaaccaggagaagcuccucuacgagugcaccaucuccgccuccuccccccucuaccccgccuucuggcucuacggccuccaccccggcaacuaccucaucaucaagcaggucaaggucuga

SEQ ID NO: 9358 - RNA, 1299 nt, Artificial Sequence
  derived and/or modified sequence opt3 from RIG-I__Homo_sapiens__AAI26421
auggccggccuggggcucggaagcgcugugcccgucuggcuugcagaggacgaucuggguugcaucauuugucagggcuuguuagacuggccugccacccugccaugcgggcacuccuucuguagacauugccuagaagcgcucuggggagcuagggaugcccggcgcugggcauguccgacaugccgacaaggcgccgcucagcagccccaucugcguaagaacacucuucugcaggacuuggcagauaaauacagaagggccgcucgggagauacaagccgguucugacccugcgcacuguccaugccccgggucaaguagccucuccucugcagccgcucgcccuagaaggcggccagaacugcagcgcguugccguggagaagucgaucacggaaguagcacaggagcugaccgagcucguggaacacuuagucgauauugugcgaucacugcagaaucaaagaccccuuagcgagaguggaccugacaacgaauuguccauccugggcaaggcuuuuucuagcggcguugaucuauccauggccucaccaaaacucgugacaagugacacugcggccgggaaaauuagggauauccugcaugaccuugaggagauacaggaaaagcugcaggagagcgucaccuggaaggaagcaccggaggcucagaugcaaggagaauugcucgaggcccccucuuccucaagcuguccucugccagaucagagucaccccgcuuuacggcgugccucucgcuucgcacagugggccauccacccuacauuuaaucugaaaucccucagcugcucgcuugaggugucuaaggacuccagaaccguaacuguuucacauaggccacaacccuaucgguggaguugugaacgauucagcacaucccaggugcugugcucucaggcuuugagcucagguaaacacuacugggaggucgacacccgcaacugcagucauugggcggugggcguggcauccugggaaaugagcagagaucagguccuagggaggacgauggacucuuguugcguugaguggaagggaacuucacaacugagugccuggcacauggugaaagaaaccguacucggcagcgaucggccggguguggucgggauuuggcugaaucuugaggagggaaagcuggcuuuuuauuccguggacaaccaggaaaaguugcucuacgaguguacaaucucugccucgagcccucuguaucccgcauucugguuauacggccugcacccaggcaauuaucuaauuaucaaacagguuaagguguga

SEQ ID NO: 9359 - RNA, 1299 nt, Artificial Sequence
  derived and/or modified sequence opt4 from RIG-I__Homo_sapiens__AAI26421
auggccggccugggccugggcagcgccgugcccguguggcuggccgaggacgaccugggcugcaucaucugccagggccugcuggacuggcccgccacccugcccugcggccacagcuucugcagacacugccuggaggcccuguggggcgccagagacgccagaagaugggccugccccaccugcagacagggcgccgcccagcagccccaccugagaaagaacacccugcugcaggaccuggccgacaaguacagaagagccgccagagagauccaggccggcagcgaccccgcccacugccccugccccggcagcagcagccugagcagcgccgccgccagacccagaagaagacccgagcugcagagaguggccguggagaagagcaucaccgagguggcccaggagcugaccgagcugguggagcaccugguggacaucgugagaagccugcagaaccagagaccccugagcgagagcggccccgacaacgagcugagcauccugggcaaggccuucagcagcggcguggaccugagcauggccagccccaagcuggugaccagcgacaccgccgccggcaagaucagagacauccugcacgaccuggaggagauccaggagaagcugcaggagagcgugaccuggaaggaggcccccgaggcccagaugcagggcgagcugcuggaggcccccagcagcagcagcugcccccugcccgaccagagccaccccgcccugagaagagccagcagauucgcccagugggccauccaccccaccuucaaccugaagagccugagcugcagccuggaggugagcaaggacagcagaaccgugaccgugagccacagaccccagcccuacagauggagcugcgagagauucagcaccagccaggugcugugcagccaggcccugagcagcggcaagcacuacugggagguggacaccagaaacugcagccacugggccgugggcguggccagcugggagaugagcagagaccaggugcugggcagaaccauggacagcugcugcguggaguggaagggcaccagccagcugagcgccuggcacauggugaaggagaccgugcugggcagcgacagacccggcguggugggcaucuggcugaaccuggaggagggcaagcuggccuucuacagcguggacaaccaggagaagcugcuguacgagugcaccaucagcgccagcagcccccuguaccccgccuucuggcuguacggccugcaccccggcaacuaccugaucaucaagcaggugaagguguga

SEQ ID NO: 9360 - RNA, 1299 nt, Artificial Sequence
  derived and/or modified sequence opt5 from RIG-I__Homo_sapiens__AAI26421
auggccggccuggggcucggaagcgcugugcccgucuggcuggccgaggacgaucuuggcugcaucauuugucaggggcugcucgacuggccugcgacccugccgugcggacacuccuucuguagacauugccuugaagcucuguggggcgcccgggaugcccgcagaugggcuugucccacaugccggcaaggggccgcucagcagccucaccuccgcaagaacacgcugcugcaggaccucgccgauaaauacagacgggcggcccgcgagauccaagcuggaucugaccccgcccauuguccuugccccggcagcuccucucugagcuccgcugccgcgagaccucggcgcagaccggaacuucagcggguugccguggagaagucuauuaccgaaguggcucaggagcugacagagcucgucgaacaccugguggauaucguucgcagccuucagaaucaaagaccccuguccgagagcggcccugacaacgaacucucuauucuggggaaagccuuuuccagcggaguggaucugucuauggcuucccccaagcucgucaccagcgacacagccgccggcaaaauccgggauauccugcaugaccuugaggagauucaggaaaagcugcaggagucugugaccuggaaggaagcuccugaggcgcagaugcaaggggaacuccuggaggcccccuccagcuccucuuguccgcuuccugaucagagccaccccgcucugcgcagagccucccgguucgcccagugggcuauccacccuacauuuaaucucaaaagccugucuugcucccuggagguuagcaaggacucuagaaccgugacggucagccaucgcccccaacccuaucggugguccugugaaagauucucuaccagccaggugcucugcucccaggcccugagcucuggaaaacacuacugggagguggacacacgcaacugcucccauugggcggucggcguugcuagcugggaaaugucucgggaucaggugcuugggagaaccauggacuccuguugcguggaguggaagggaacaagccaacuguccgccuggcacauggucaaagaaaccgugcucggcucugaucgcccuggcguuguggggauuuggcugaaucuugaggagggaaagcuggccuuuuauagcgucgacaaccaggaaaagcuccuguacgaguguacgaucuccgcuucuagcccgcuguaucccgccuucuggcucuacggccugcacccugggaauuaucuuauuaucaaacaggugaagguuuga

SEQ ID NO: 9361 - protein, 836 aa, Artificial Sequence
  Src-Kinases__Homo_sapiens__Q9H5V8
MAGLNCGVSIALLGVLLLGAARLPRGAEAFEIALPRESNITVLIKLGTPTLLAKPCYIVISKRHITMLSIKSGERIVFTFSCQSPENHFVIEIQKNIDCMSGPCPFGEVQLQPSTSLLPTLNRTFIWDVKAHKSIGLELQFSIPRLRQIGPGESCPDGVTHSISGRIDATVVRIGTFCSNGTVSRIKMQEGVKMALHLPWFHPRNVSGFSIANRSSIKRLCIIESVFEGEGSATLMSANYPEGFPEDELMTWQFVVPAHLRASVSFLNFNLSNCERKEERVEYYIPGSTTNPEVFKLEDKQPGNMAGNFNLSLQGCDQDAQSPGILRLQFQVLVQHPQNESNKIYVVDLSNERAMSLTIEPRPVKQSRKFVPGCFVCLESRTCSSNLTLTSGSKHKISFLCDDLTRLWMNVEKTISCTDHRYCQRKSYSLQVPSDILHLPVELHDFSWKLLVPKDRLSLVLVPAQKLQQHTHEKPCNTSFSYLVASAIPSQDLYFGSFCPGGSIKQIQVKQNISVTLRTFAPSFQQEASRQGLTVSFIPYFKEEGVFTVTPDTKSKVYLRTPNWDRGLPSLTSVSWNISVPRDQVACLTFFKERSGVVCQTGRAFMIIQEQRTRAEEIFSLDEDVLPKPSFHHHSFWVNISNCSPTSGKQLDLLFSVTLTPRTVDLTVILIAAVGGGVLLLSALGLIICCVKKKKKKTNKGPAVGIYNDNINTEMPRQPKKFQKGRKDNDSHVYAVIEDTMVYGHLLQDSSGSFLQPEVDTYRPFQGTMGVCPPSPPTICSRAPTAKLATEEPPPRSPPESESEPYTFSHPNNGDVSSKDTDIPLLNTQEPMEPAE

SEQ ID NO: 9362 - RNA, 2511 nt, Artificial Sequence
  Src-Kinases__Homo_sapiens__AAO34538
auggccggccugaacugcggggucucuaucgcacugcuagggguucugcugcugggugcggcgcgccugccgcgcggggcagaagcuuuugagauugcucugccacgagaaagcaacauuacaguucucauaaagcuggggaccccgacucugcuggcaaaacccuguuacaucgucauuucuaaaagacauauaaccauguuguccaucaagucuggagaaagaauagucuuuaccuuuagcugccagaguccugagaaucacuuugucauagagauccagaaaaauauugacuguaugucaggcccauguccuuuuggggagguucagcuucagcccucgacaucguuguugccuacccucaacagaacuuucaucugggaugucaaagcucauaagagcaucgguuuagagcugcaguuuuccaucccucgccugaggcagaucgguccgggugagagcugcccagacggagucacucacuccaucagcggccgaaucgaugccaccguggucaggaucggaaccuucugcagcaauggcacugugucccggaucaagaugcaagaaggagugaaaauggccuuacaccucccaugguuccaccccagaaaugucuccggcuucagcauugcaaaccgcucaucuauaaaacgucugugcaucaucgagucuguguuugagggugaaggcucagcaacccugaugucugccaacuacccagaaggcuucccugaggaugagcucaugacguggcaguuugucguuccugcacaccugcgggccagcgucuccuuccucaacuucaaccucuccaacugugagaggaaggaggagcggguugaauacuacaucccgggcuccaccaccaaccccgagguguucaagcuggaggacaagcagccugggaacauggcggggaacuucaaccucucucugcaaggcugugaccaagaugcccaaaguccagggauccuccggcugcaguuccaaguuuugguccaacauccacaaaaugaaagcaauaaaaucuacgugguugacuugaguaaugagcgagccaugucacucaccaucgagccacggcccgucaaacagagccgcaaguuugucccuggcuguuucgugugucuagaaucucggaccugcaguagcaaccucacccugacaucuggcuccaaacacaaaaucuccuuccuuugugaugaucugacacgucuguggaugaauguggaaaaaaccauaagcugcacagaccaccgguacugccaaaggaaauccuacucacuccaggugcccagugacauccuccaccugccuguggagcugcaugacuucuccuggaagcugcuggugcccaaggacaggcucagccuggugcuggugccagcccagaagcugcagcagcauacacacgagaagcccugcaacaccagcuucagcuaccucguggccagugccauacccagccaggaccuguacuucggcuccuucugcccgggaggcucuaucaagcagauccaggugaagcagaacaucucggugacccuucgcaccuuugcccccagcuuccaacaagaggccuccaggcagggucugacgguguccuuuauaccuuauuucaaagaggaaggcguuuucacggugaccccugacacaaaaagcaaggucuaccugaggacccccaacugggaccggggccugccaucccucaccucuguguccuggaacaucagcgugcccagagaccagguggccugccugacuuucuuuaaggagcggagcggcguggucugccagacagggcgcgcauucaugaucauccaggagcagcggacccgggcugaggagaucuucagccuggacgaggaugugcuccccaagccaagcuuccaccaucacagcuucugggucaacaucucuaacugcagccccacgagcggcaagcagcuagaccugcucuucucggugacacuuaccccaaggacuguggacuugacugucauccucaucgcagcggugggagguggagucuuacugcugucugcccucgggcucaucauuugcugugugaaaaagaagaaaaagaagacaaacaagggccccgcuguggguaucuacaaugacaacaucaauacugagaugccgaggcagccaaaaaaguuucagaaagggcgaaaggacaaugacucccauguguaugcagucaucgaggacaccaugguauaugggcaucugcuacaggauuccagcggcuccuuccugcagccagagguggacaccuaccggccguuccagggcaccaugggggucuguccucccuccccacccaccauaugcuccagggccccaacugcaaaguuggccacugaggagccaccuccucgcuccccuccugagucugagagugaaccguacaccuucucccaucccaacaauggggauguaagcagcaaggacacagacauucccuuacugaacacucaggagcccauggagccagcagaauaa

SEQ ID NO: 9363 - RNA, 2511 nt, Artificial Sequence
  derived and/or modified sequence opt1 from Src-Kinases__Homo_sapiens__AAO34538
auggccggccugaacugcggggugagcaucgcccuccugggcguccugcuccugggggcggcccgccugccccggggcgccgaggccuucgagaucgcccucccgcgcgaguccaacaucaccgugcugaucaagcuggggacccccacgcuccuggcgaagcccugcuacaucgugaucagcaagcggcacaucaccaugcuguccaucaagagcggcgagcgcaucgucuucaccuucuccugccagagccccgagaaccacuucgugaucgagauccagaagaacaucgacugcauguccggcccgugccccuucggggaggugcagcuccagcccagcaccucccugcugcccacgcucaaccggaccuucaucugggacgucaaggcccacaagagcaucggccuggagcugcaguucuccaucccgcgccuccggcagaucgggcccggcgagagcugccccgacggggugacccacuccaucagcggccgcaucgacgccaccgugguccggaucggcacguucugcuccaacgggaccgugagccgcaucaagaugcaggagggcgugaagauggcccugcaccuccccugguuccacccgcggaacgucuccggguucagcaucgcgaaccgcuccagcaucaagcggcugugcaucaucgagagcguguucgagggcgagggcuccgccacccugaugagcgccaacuaccccgagggguuccccgaggacgagcugaugaccuggcaguucgugguccccgcccaccuccgcgccuccgugagcuuccugaacuucaaccuguccaacugcgagcggaaggaggagcgcguggaguacuacaucccgggcagcacgaccaaccccgaggucuucaagcucgaggacaagcagcccgggaacauggcgggcaacuucaaccugucccugcaggggugcgaccaggacgcccagagccccggcauccuccggcugcaguuccaggugcuggugcagcacccgcagaacgaguccaacaagaucuacgucguggaccucagcaacgagcgcgccaugucccugaccaucgagccccggcccgugaagcagagccgcaaguucguccccggcugcuucgugugccuggagucccggaccugcagcuccaaccucacgcugaccagcggguccaagcacaagaucagcuuccugugcgacgaccucacccgccuguggaugaacgucgagaagaccaucuccugcacggaccaccgcuacugccagcgcaagagcuacagccuccaggugccguccgacauccugcaccuccccguggagcugcacgacuucagcuggaagcugcugguccccaaggaccggcugucccucgugcuggugcccgcccagaagcugcagcagcacacccacgagaagccgugcaacaccagcuucuccuaccuggucgccagcgcgauccccucccaggaccucuacuucggcagcuucugccccgggggcuccaucaagcagauccaggugaagcagaacaucagcgugacccugcggacguucgccccguccuuccagcaggaggccagccgccaggggcugaccgucuccuucauccccuacuucaaggaggagggcguguucaccgugacccccgacaccaagagcaaggucuaccuccggacgcccaacugggaccgcggccugccgucccugaccagcguguccuggaacaucagcgugccccgggaccaggucgccugccucaccuucuucaaggagcgcagcgggguggugugccagacgggccgggccuucaugaucauccaggagcagcgcacccgggcggaggagaucuucucccuggacgaggacguccugcccaagcccagcuuccaccaccacuccuucugggugaacaucagcaacugcuccccgaccagcgggaagcagcucgaccugcuguucuccgugacccucacgccccgcaccgucgaccugaccgugauccugaucgccgccgugggcgggggcguccuccugcugagcgcccucggccugaucaucugcugcgugaagaagaagaagaagaagaccaacaaggggcccgccgugggcaucuacaacgacaacaucaacaccgagaugccccggcagccgaagaaguuccagaaggggcgcaaggacaacgacucccacgucuacgcggugaucgaggacacgaugguguacggccaccuccugcaggacagcuccggcagcuuccugcagcccgaggucgacaccuaccggcccuuccaggggaccaugggcgugugcccgcccuccccgcccaccaucugcagccgcgcccccacggccaagcuggccaccgaggagcccccgccccgguccccgcccgagagcgaguccgagcccuacaccuucagccaccccaacaacggggacguguccagcaaggacaccgacaucccccuccugaacacgcaggagcccauggagcccgcggaguga

SEQ ID NO: 9364 - RNA, 2511 nt, Artificial Sequence
  derived and/or modified sequence opt2 from Src-Kinases__Homo_sapiens__AAO34538
auggccggccucaacugcggcgucuccaucgcccuccucggcguccuccuccucggcgccgcccgccucccccgcggcgccgaggccuucgagaucgcccucccccgcgaguccaacaucaccguccucaucaagcucggcacccccacccuccucgccaagcccugcuacaucgucaucuccaagcgccacaucaccaugcucuccaucaaguccggcgagcgcaucgucuucaccuucuccugccagucccccgagaaccacuucgucaucgagauccagaagaacaucgacugcauguccggccccugccccuucggcgagguccagcuccagcccuccaccucccuccuccccacccucaaccgcaccuucaucugggacgucaaggcccacaaguccaucggccucgagcuccaguucuccaucccccgccuccgccagaucggccccggcgaguccugccccgacggcgucacccacuccaucuccggccgcaucgacgccaccgucguccgcaucggcaccuucugcuccaacggcaccgucucccgcaucaagaugcaggagggcgucaagauggcccuccaccuccccugguuccacccccgcaacgucuccggcuucuccaucgccaaccgcuccuccaucaagcgccucugcaucaucgaguccgucuucgagggcgagggcuccgccacccucauguccgccaacuaccccgagggcuuccccgaggacgagcucaugaccuggcaguucgucguccccgcccaccuccgcgccuccgucuccuuccucaacuucaaccucuccaacugcgagcgcaaggaggagcgcgucgaguacuacauccccggcuccaccaccaaccccgaggucuucaagcucgaggacaagcagcccggcaacauggccggcaacuucaaccucucccuccagggcugcgaccaggacgcccagucccccggcauccuccgccuccaguuccagguccucguccagcacccccagaacgaguccaacaagaucuacgucgucgaccucuccaacgagcgcgccaugucccucaccaucgagccccgccccgucaagcagucccgcaaguucguccccggcugcuucgucugccucgagucccgcaccugcuccuccaaccucacccucaccuccggcuccaagcacaagaucuccuuccucugcgacgaccucacccgccucuggaugaacgucgagaagaccaucuccugcaccgaccaccgcuacugccagcgcaaguccuacucccuccagguccccuccgacauccuccaccuccccgucgagcuccacgacuucuccuggaagcuccucguccccaaggaccgccucucccucguccucguccccgcccagaagcuccagcagcacacccacgagaagcccugcaacaccuccuucuccuaccucgucgccuccgccauccccucccaggaccucuacuucggcuccuucugccccggcggcuccaucaagcagauccaggucaagcagaacaucuccgucacccuccgcaccuucgcccccuccuuccagcaggaggccucccgccagggccucaccgucuccuucauccccuacuucaaggaggagggcgucuucaccgucacccccgacaccaaguccaaggucuaccuccgcacccccaacugggaccgcggccuccccucccucaccuccgucuccuggaacaucuccgucccccgcgaccaggucgccugccucaccuucuucaaggagcgcuccggcgucgucugccagaccggccgcgccuucaugaucauccaggagcagcgcacccgcgccgaggagaucuucucccucgacgaggacguccuccccaagcccuccuuccaccaccacuccuucugggucaacaucuccaacugcucccccaccuccggcaagcagcucgaccuccucuucuccgucacccucaccccccgcaccgucgaccucaccgucauccucaucgccgccgucggcggcggcguccuccuccucuccgcccucggccucaucaucugcugcgucaagaagaagaagaagaagaccaacaagggccccgccgucggcaucuacaacgacaacaucaacaccgagaugccccgccagcccaagaaguuccagaagggccgcaaggacaacgacucccacgucuacgccgucaucgaggacaccauggucuacggccaccuccuccaggacuccuccggcuccuuccuccagcccgaggucgacaccuaccgccccuuccagggcaccaugggcgucugcccccccuccccccccaccaucugcucccgcgcccccaccgccaagcucgccaccgaggagccccccccccgcuccccccccgaguccgaguccgagcccuacaccuucucccaccccaacaacggcgacgucuccuccaaggacaccgacaucccccuccucaacacccaggagcccauggagcccgccgaguga

SEQ ID NO: 9365 - RNA, 2511 nt, Artificial Sequence
  derived and/or modified sequence opt3 from Src-Kinases__Homo_sapiens__AAO34538
auggccggccugaacugcggggugagcaucgcucuccuuggaguccuguuguuaggugcagccagacugcccaggggcgcggaggcuuucgaaauugcccuaccucgggaguccaauauaaccguucucaucaagcuggggacaccaacucuucuggcaaaaccguguuacauugugaucucuaagcgccacauuacgauguugucaaucaaaaguggagaacgaauaguauuuaccuucagcugccagucccccgagaaccauuuugugaucgaaauucaaaagaauaucgacuguaugucuggcccuugcccauucggugagguccagcuccagcccucgacaucacugcugccuacucucaaccguaccuuuauuugggaugugaaagcccacaagagcaucggguuagagcugcaguucaguauaccaagacuuaggcaaauuggacccggcgaauccuguccugacggcguuacacauucuaucagcgggcggauugaugcuaccgugguccgcaucggaacuuuuugcuccaaugguacagugucaagaaucaagaugcaggagggcguaaaaauggcauugcaucugccaugguuccacccgaggaacguuaguggguuuagcauugccaaucggucuuccauaaagcgccuauguaucauugaaucaguguucgagggagagggcagcgcuacccucaugagugccaacuaucccgaagguuuuccugaggacgaacugaugacguggcaguucgucgugccagcgcaccuucgagcaucuguguccuuucugaauuucaacuugagcaauugcgagagaaaagaagagagggucgaguacuauauccccgggucgacuaccaacccugaaguuuucaagcucgaggauaaacagccaggaaauauggccggcaacuuuaaucugucuuuacaaggcugugaccaggaugcucagucccccgggauacugcggcuccaguuccaagugcuuguacagcacccgcagaacgaaucaaacaagauuuacguggucgaccugaguaaugagcgugccaugagcuugacaaucgaaccucgccccgugaagcaauccagaaaauuuguuccaggaugcuucgugugucuagagucuaggacuugcagcucaaaccugacccucacaagugguuccaagcauaaaaucagcuuucugugcgaugaccuuacccggcuguggaugaaugucgagaagacgauuucuuguacugaucaccgauauugccagcgcaaaucauacagucuccaggugccuagcgacaucuugcaucugcccguagaauuacacgauuucuccuggaagcugcuaguuccaaaagacagacucucucuggugcuuguccccgcacagaaguugcaacagcacacacaugagaagccuuguaacaccucguuuagcuaucugguggcuuccgccauuccaucacaggaccucuacuucggcaguuuuugccccgggggaucuauaaaacagauccaagucaagcagaauauuagcgugacucugaggacauucgcgcccuccuuucagcaggaagccucacggcaaggccuuaccguuagcuucaucccuuacuuuaaagaggaagguguguucacgguaaccccagauacaaagucuaaagucuaucugcgcacucccaacugggacagaggguugccuucccucaccagugugagcuggaauaucucuguuccaagggaucagguggcaugucugacauucuuuaaggagcguuccggcgucgugugccagacuggacgggcuuucaugauuauacaggagcaacgaaccagagccgaagagaucuuuucauuagacgaagauguacugcccaagccgaguuuccaccaucacagcuuuugggugaacauuucgaauuguuccccuacaucuggcaaacagcuagaccuccuguucagcguuacccuuacuccaaggacggucgauuugacagugauccugauugcugccgucgggggaggugugcuccuguuaucagcacugggccuuaucauaugcuguguuaagaaaaagaaaaagaagaccaacaaagggcccgccgugggaaucuacaaugacaacauuaauacugagaugccucgccagcccaagaaauuucaaaagggccggaaagauaacgacagucauguguaugcuguaaucgaggauaccauggucuacggucacuugcuccaggacuccucugggagcuuccugcagccagaaguggacacauauagaccuuuucagggcaccaugggaguuugcccgccauccccgccuacuauuuguucaagggcgcccacagcaaagcuagccacggaggaaccacccccucgcagcccacccgagagugaaucugagccuuacaccuucucccacccgaauaacggcgaugugagcucgaaggacacugauaucccacugcucaacacacaagagcccauggaaccugcugaguga

SEQ ID NO: 9366 - RNA, 2511 nt, Artificial Sequence
  derived and/or modified sequence opt4 from Src-Kinases__Homo_sapiens__AAO34538
auggccggccugaacugcggcgugagcaucgcccugcugggcgugcugcugcugggcgccgccagacugcccagaggcgccgaggccuucgagaucgcccugcccagagagagcaacaucaccgugcugaucaagcugggcacccccacccugcuggccaagcccugcuacaucgugaucagcaagagacacaucaccaugcugagcaucaagagcggcgagagaaucguguucaccuucagcugccagagccccgagaaccacuucgugaucgagauccagaagaacaucgacugcaugagcggccccugccccuucggcgaggugcagcugcagcccagcaccagccugcugcccacccugaacagaaccuucaucugggacgugaaggcccacaagagcaucggccuggagcugcaguucagcauccccagacugagacagaucggccccggcgagagcugccccgacggcgugacccacagcaucagcggcagaaucgacgccaccguggugagaaucggcaccuucugcagcaacggcaccgugagcagaaucaagaugcaggagggcgugaagauggcccugcaccugcccugguuccaccccagaaacgugagcggcuucagcaucgccaacagaagcagcaucaagagacugugcaucaucgagagcguguucgagggcgagggcagcgccacccugaugagcgccaacuaccccgagggcuuccccgaggacgagcugaugaccuggcaguucguggugcccgcccaccugagagccagcgugagcuuccugaacuucaaccugagcaacugcgagagaaaggaggagagaguggaguacuacauccccggcagcaccaccaaccccgagguguucaagcuggaggacaagcagcccggcaacauggccggcaacuucaaccugagccugcagggcugcgaccaggacgcccagagccccggcauccugagacugcaguuccaggugcuggugcagcacccccagaacgagagcaacaagaucuacgugguggaccugagcaacgagagagccaugagccugaccaucgagcccagacccgugaagcagagcagaaaguucgugcccggcugcuucgugugccuggagagcagaaccugcagcagcaaccugacccugaccagcggcagcaagcacaagaucagcuuccugugcgacgaccugaccagacuguggaugaacguggagaagaccaucagcugcaccgaccacagauacugccagagaaagagcuacagccugcaggugcccagcgacauccugcaccugcccguggagcugcacgacuucagcuggaagcugcuggugcccaaggacagacugagccuggugcuggugcccgcccagaagcugcagcagcacacccacgagaagcccugcaacaccagcuucagcuaccugguggccagcgccauccccagccaggaccuguacuucggcagcuucugccccggcggcagcaucaagcagauccaggugaagcagaacaucagcgugacccugagaaccuucgcccccagcuuccagcaggaggccagcagacagggccugaccgugagcuucauccccuacuucaaggaggagggcguguucaccgugacccccgacaccaagagcaagguguaccugagaacccccaacugggacagaggccugcccagccugaccagcgugagcuggaacaucagcgugcccagagaccagguggccugccugaccuucuucaaggagagaagcggcguggugugccagaccggcagagccuucaugaucauccaggagcagagaaccagagccgaggagaucuucagccuggacgaggacgugcugcccaagcccagcuuccaccaccacagcuucugggugaacaucagcaacugcagccccaccagcggcaagcagcuggaccugcuguucagcgugacccugacccccagaaccguggaccugaccgugauccugaucgccgccgugggcggcggcgugcugcugcugagcgcccugggccugaucaucugcugcgugaagaagaagaagaagaagaccaacaagggccccgccgugggcaucuacaacgacaacaucaacaccgagaugcccagacagcccaagaaguuccagaagggcagaaaggacaacgacagccacguguacgccgugaucgaggacaccaugguguacggccaccugcugcaggacagcagcggcagcuuccugcagcccgagguggacaccuacagacccuuccagggcaccaugggcgugugcccccccagcccccccaccaucugcagcagagcccccaccgccaagcuggccaccgaggagcccccccccagaagcccccccgagagcgagagcgagcccuacaccuucagccaccccaacaacggcgacgugagcagcaaggacaccgacaucccccugcugaacacccaggagcccauggagcccgccgaguga

SEQ ID NO: 9367 - RNA, 2511 nt, Artificial Sequence
  derived and/or modified sequence opt5 from Src-Kinases__Homo_sapiens__AAO34538
auggccggccugaacugcggggugagcaucgcucuccugggaguccuucugcucggcgccgcgagacugccccggggagcugaggccuucgaaauugcccuuccucgcgaguccaauaucaccguucugauuaagcucggaacaccgacgcugcuggcuaaacccuguuacaucgugauuucuaagagacacaucaccaugcucagcaucaaauccggcgaacggauuguguuuacauucucuugccagagcccugagaaccacuuugucaucgaaauucaaaagaauaucgacuguauguccgggcccugcccuuucggagaggugcagcugcagcccucuaccagccuucugccuacacucaaccgcaccuuuauuugggauguuaaagcccacaaguccaucggccuggagcuucaguucagcauuccgagacugcggcaaaucggccccggggaaucuuguccugacggagugacacauuccaucagcggccgcauugaugcuaccgucgugagaaucgggacguuuugcucuaauggaaccguuucccggauuaagaugcaggagggcgugaaaauggcccuccaucugcccugguuccacccucgcaacgucagcggguuuucuaucgcgaauagauccagcauuaagcggcuguguaucaucgaauccguguucgagggagagggcucugccacacucaugagcgcuaacuaucccgaaggcuuuccggaggacgaacugaugaccuggcaguucguggucccugcccaccuucgcgcuuccguuagcuuucugaauuucaaccucucuaauugcgagagaaaagaggaacggguggaguacuauauucccggguccacaaccaacccugaaguguucaagcuggaggauaaacagcccggaaauauggccggcaacuuuaaucuuagccugcaagggugugaccaggaugcgcagucucccggaauccuccgccugcaguuccaaguccuggugcagcacccucagaacgaaagcaacaagauuuacguuguggaccucuccaaugagagagccaugucucugacgaucgaaccgcggcccgucaagcaaagcagaaaauuugugccuggcugcuucguuugucuugagucccgcacaugcagcucuaaccugacccucacauccgggagcaagcauaaaauuucuuuucugugcgaugaccuuacccggcuguggaugaauguggagaagaccaucuccuguacagaucacagauauugccagcgcaaaagcuacucccuccagguccccucugacauccugcaucugccuguggaacuccacgauuucagcuggaagcugcuuguccccaaagaccggcugucccucgugcugguuccggcucagaagcugcaacagcacacgcaugagaagccuuguaacaccucuuuuagcuaucuuguggccuccgcuauucccagccaggaccucuacuucggaucuuuuugcccuggcggcuccaucaaacagauucaagucaagcagaauaucagcgugacacugagaaccuucgcccccucuuuucagcaggaagccucccgccaagggcugacaguuagcuucauuccuuacuuuaaagaggaaggaguguucaccgucacgcccgauacaaagucuaaaguguaucuccggaccccgaacugggacagaggccugccuagccuuaccuccgugagcuggaauaucucuguuccccgcgaucaggucgcuugucugacauucuuuaaggagcgguccgggguggugugccagaccgggagagcguucaugauuauccaggagcaacgcacacgggccgaagagaucuuuagccucgacgaagauguccugcccaagccuuccuuccaccaucacucuuuuugggugaacauuagcaauuguuccccgacgucuggcaaacagcuggaccuucucuucagcguuacccugacacccagaaccguggaucugacagucauccucauugcugccgugggaggcggaguucugcuucuguccgcccucggccugaucauuugcugugugaagaaaaagaaaaagaagaccaacaaagggccugcugucggaaucuacaaugacaacaucaauacggagaugccccggcagccuaagaaauuucaaaagggccgcaaagauaacgacucucauguguaugccguuauugaggauaccaugguguacgggcaucugcuucaggacagcuccgggagcuuccuccagcccgaagucgacacauauagaccuuuucagggcaccaugggggugugucccccgucuccucccacaaucugcucccgggcgccuaccgcuaagcuggccacggaggaacccccgccuagaucucccccugagagcgaauccgagcccuacacauucagccaccccaauaacggcgaugugucuuccaaggacaccgauauuccucugcucaacacacaagagccgauggaacccgccgaguga

SEQ ID NO: 9368 - protein, 248 aa, Artificial Sequence
  Surfactant_protein_A__Homo_sapiens__Q8IWL1
MWLCPLALNLILMAASGAACEVKDVCVGSPGIPGTPGSHGLPGRDGRDGVKGDPGPPGPMGPPGETPCPPGNNGLPGAPGVPGERGEKGEAGERGPPGLPAHLDEELQATLHDFRHQILQTRGALSLQGSIMTVGEKVFSSNGQSITFDAIQEACARAGGRIAVPRNPEENEAIASFVKKYNTYAYVGLTEGPSPGDFRYSDGTPVNYTNWYRGEPAGRGKEQCVEMYTDGQWNDRNCLYSRLTICEF

SEQ ID NO: 9369 - RNA, 747 nt, Artificial Sequence
  Surfactant_protein_A__Homo_sapiens__AAI57867
auguggcugugcccucuggcccucaaccucaucuugauggcagccucuggugcugcgugcgaagugaaggacguuuguguuggaagcccugguauccccggcacuccuggaucccacggccugccaggcagggacgggagagauggugucaaaggagacccuggcccuccaggccccauggguccgccuggagaaacaccauguccuccugggaauaaugggcugccuggagccccuggugucccuggagagcguggagagaagggggaggcuggcgagagaggcccuccagggcuuccagcucaucuagaugaggagcuccaagccacacuccacgacuucagacaucaaauccugcagacaaggggagcccucagucugcagggcuccauaaugacaguaggagagaaggucuucuccagcaaugggcaguccaucacuuuugaugccauucaggaggcaugugccagagcaggcggccgcauugcugucccaaggaauccagaggaaaaugaggccauugcaagcuucgugaagaaguacaacacauaugccuauguaggccugacugagggucccagcccuggagacuuccgcuacucagaugggaccccuguaaacuacaccaacugguaccgaggggagccugcaggucggggaaaagagcaguguguggagauguacacagaugggcaguggaaugacaggaacugccuguacucccgacugaccaucugugaguucuga

SEQ ID NO: 9370 - RNA, 747 nt, Artificial Sequence
  derived and/or modified sequence opt1 from Surfactant_protein_A__Homo_sapiens__AAI57867
auguggcugugcccccucgcccugaaccugauccucauggccgcgagcggcgccgccugcgaggugaaggacgucugcgugggguccccgggcauccccgggacccccggcagccacgggcugcccggccgcgacggccgggacggggugaagggcgacccggggccgcccggccccauggggccgcccggcgagacccccugcccgcccggcaacaacgggcugcccggcgcccccgggguccccggcgagcgcggcgagaagggggaggccggcgagcgggggccgcccggccuccccgcgcaccuggacgaggagcugcaggccacgcuccacgacuuccgccaccagauccugcagacccgcggggcccugucccuccagggcagcaucaugaccgugggcgagaagguguucuccagcaacgggcaguccaucaccuucgacgccauccaggaggcgugcgcccgggccggcgggcggaucgccgucccccgcaaccccgaggagaacgaggccaucgcgagcuucgugaagaaguacaacacguacgccuacgugggccugaccgaggggcccucccccggcgacuuccgguacagcgacggcacccccgucaacuacaccaacugguaccgcggggagccggccggccgggggaaggagcagugcguggagauguacacggacggccaguggaacgaccgcaacugccuguacucccggcucaccaucugcgaguucuga

SEQ ID NO: 9371 - RNA, 747 nt, Artificial Sequence
  derived and/or modified sequence opt2 from Surfactant_protein_A__Homo_sapiens__AAI57867
auguggcucugcccccucgcccucaaccucauccucauggccgccuccggcgccgccugcgaggucaaggacgucugcgucggcucccccggcauccccggcacccccggcucccacggccuccccggccgcgacggccgcgacggcgucaagggcgaccccggcccccccggccccaugggcccccccggcgagacccccugcccccccggcaacaacggccuccccggcgcccccggcguccccggcgagcgcggcgagaagggcgaggccggcgagcgcggcccccccggccuccccgcccaccucgacgaggagcuccaggccacccuccacgacuuccgccaccagauccuccagacccgcggcgcccucucccuccagggcuccaucaugaccgucggcgagaaggucuucuccuccaacggccaguccaucaccuucgacgccauccaggaggccugcgcccgcgccggcggccgcaucgccgucccccgcaaccccgaggagaacgaggccaucgccuccuucgucaagaaguacaacaccuacgccuacgucggccucaccgagggccccucccccggcgacuuccgcuacuccgacggcacccccgucaacuacaccaacugguaccgcggcgagcccgccggccgcggcaaggagcagugcgucgagauguacaccgacggccaguggaacgaccgcaacugccucuacucccgccucaccaucugcgaguucuga

SEQ ID NO: 9372 - RNA, 747 nt, Artificial Sequence
  derived and/or modified sequence opt3 from Surfactant_protein_A__Homo_sapiens__AAI57867
auguggcugugcccccucgcccuuaaccugaucuugauggcugcaagcggcgccgcgugugaggugaaggacgucugcguuggguccccugguauuccaggaaccccgggcucucacggguuacccggaagagauggcagggacggugugaaaggggauccuggaccacccggcccuaugggcccacccggggaaacaccuuguccaccgggaaauaacggucugcccggcgcuccugggguaccaggagagcggggcgaaaagggugaggccggggaacgcggacccccuggccuaccagcacaucucgacgaggagcugcaggccacucuucacgauuuccgacaucaaauacugcagacgcguggcgcuuugucacuccaggggaguaucaugaccgugggagaaaaagucuuuagcuccaauggucagucuauuacauucgacgcaauccaagaggccugcgcuagagccggcgggaggauugcggugccccggaacccggaagagaaugaggcaaucgccucguuuguuaagaaauacaacacuuaugcuuacgugggacugaccgaaggcccuucacccggugauuuccgcuauagcgacgggacaccagucaauuacaccaacugguauagaggcgagccugccggaaggggcaaggaacaguguguggagauguacacugaugggcaguggaaugaccggaacugccuguauagucgccucacaauaugugaauuuuga

SEQ ID NO: 9373 - RNA, 747 nt, Artificial Sequence
  derived and/or modified sequence opt4 from Surfactant_protein_A__Homo_sapiens__AAI57867
auguggcugugcccccuggcccugaaccugauccugauggccgccagcggcgccgccugcgaggugaaggacgugugcgugggcagccccggcauccccggcacccccggcagccacggccugcccggcagagacggcagagacggcgugaagggcgaccccggcccccccggccccaugggcccccccggcgagacccccugcccccccggcaacaacggccugcccggcgcccccggcgugcccggcgagagaggcgagaagggcgaggccggcgagagaggcccccccggccugcccgcccaccuggacgaggagcugcaggccacccugcacgacuucagacaccagauccugcagaccagaggcgcccugagccugcagggcagcaucaugaccgugggcgagaagguguucagcagcaacggccagagcaucaccuucgacgccauccaggaggccugcgccagagccggcggcagaaucgccgugcccagaaaccccgaggagaacgaggccaucgccagcuucgugaagaaguacaacaccuacgccuacgugggccugaccgagggccccagccccggcgacuucagauacagcgacggcacccccgugaacuacaccaacugguacagaggcgagcccgccggcagaggcaaggagcagugcguggagauguacaccgacggccaguggaacgacagaaacugccuguacagcagacugaccaucugcgaguucuga

SEQ ID NO: 9374 - RNA, 747 nt, Artificial Sequence
  derived and/or modified sequence opt5 from Surfactant_protein_A__Homo_sapiens__AAI57867
auguggcugugcccccucgcccugaaccuuauccugauggcugccagcggcgcggcuugugaggugaaggacgucugcguuggguccccugggauuccgggcacccccgggucucacggacucccuggcagagaugggcgggacggagugaaaggcgaucccggcccucccgggccuaugggaccgcccggcgaaacaccuugucccccugggaauaacggacugcccggcgccccgggggugccuggagagcgcggcgaaaagggcgaggccggggaaagaggacccccuggccuucccgcucaucuggacgaggagcuccaggccacgcugcacgauuuccggcaucaaauccugcagacccgcggggcucucagccugcagggauccauuaugacagucggcgaaaaaguguuuucuagcaaugggcaguccaucaccuucgacgccauucaagaggcgugcgccagagcuggaggccggaucgccguuccccgcaacccugaagagaaugaggcuaucgccucuuuugugaagaaauacaacacauaugcguacgucggccuuaccgaagggccgagccccggagauuucagauauuccgacggcacaccugugaauuacaccaacugguaucggggagagcccgccggacgcggcaaggaacaguguguugagauguacacggaugggcaguggaaugacagaaacugccuguauagccggcucaccauuugugaauuuuga

SEQ ID NO: 9375 - protein, 248 aa, Artificial Sequence
  Surfactant_protein_A__Homo_sapiens__Q8IWL2
MWLCPLALNLILMAASGAVCEVKDVCVGSPGIPGTPGSHGLPGRDGRDGLKGDPGPPGPMGPPGEMPCPPGNDGLPGAPGIPGECGEKGEPGERGPPGLPAHLDEELQATLHDFRHQILQTRGALSLQGSIMTVGEKVFSSNGQSITFDAIQEACARAGGRIAVPRNPEENEAIASFVKKYNTYAYVGLTEGPSPGDFRYSDGTPVNYTNWYRGEPAGRGKEQCVEMYTDGQWNDRNCLYSRLTICEF

SEQ ID NO: 9376 - RNA, 747 nt, Artificial Sequence
  Surfactant_protein_A__Homo_sapiens__AAI11571
auguggcugugcccucuggcccucaaccucaucuugauggcagccucuggugcugugugcgaagugaaggacguuuguguuggaagcccugguauccccggcacuccuggaucccacggccugccaggcagggacgggagagauggucucaaaggagacccuggcccuccaggccccauggguccaccuggagaaaugccauguccuccuggaaaugaugggcugccuggagccccugguaucccuggagaguguggagagaagggggagccuggcgagaggggcccuccagggcuuccagcucaucuagaugaggagcuccaagccacacuccacgacuuuagacaucaaauccugcagacaaggggagcccucagucugcagggcuccauaaugacaguaggagagaaggucuucuccagcaaugggcaguccaucacuuuugaugccauucaggaggcaugugccagagcaggcggccgcauugcugucccaaggaauccagaggaaaaugaggccauugcaagcuucgugaagaaguacaacacauaugccuauguaggccugacugagggucccagcccuggagacuuccgcuacucagacgggaccccuguaaacuacaccaacugguaccgaggggagcccgcaggucggggaaaagagcaguguguggagauguacacagaugggcaguggaaugacaggaacugccuguacucccgacugaccaucugugaguucuga

SEQ ID NO: 9377 - RNA, 747 nt, Artificial Sequence
  derived and/or modified sequence opt1 from Surfactant_protein_A__Homo_sapiens__AAI11571
auguggcugugcccccucgcccugaaccugauccucauggccgcgagcggcgccgugugcgaggucaaggacgugugcgugggguccccgggcauccccgggacccccggcagccacgggcugcccggccgcgacggccgggacgggcugaagggcgacccggggccgcccggccccauggggccgcccggcgagaugcccugcccgcccggcaacgacgggcuccccggcgcccccgggauccccggcgagugcggcgagaagggggagcccggcgagcgcgggccgcccggccugcccgcccaccuggacgaggagcuccaggccacccugcacgacuuccggcaccagauccugcagacgcgcggggcgcucucccugcagggcagcaucaugaccgucggcgagaagguguucuccagcaacgggcaguccaucaccuucgacgccauccaggaggccugcgcccgggcgggcgggcgcaucgccgugccccggaaccccgaggagaacgaggccaucgccagcuucgucaagaaguacaacaccuacgccuacgugggccugacggaggggcccucccccggcgacuuccgcuacagcgacggcaccccggugaacuacaccaacugguaccgcggggagcccgcgggccgggggaaggagcagugcgucgagauguacaccgacggccaguggaacgaccggaacugccucuacucccgccugacgaucugcgaguucuga

SEQ ID NO: 9378 - RNA, 747 nt, Artificial Sequence
  derived and/or modified sequence opt2 from Surfactant_protein_A__Homo_sapiens__AAI11571
auguggcucugcccccucgcccucaaccucauccucauggccgccuccggcgccgucugcgaggucaaggacgucugcgucggcucccccggcauccccggcacccccggcucccacggccuccccggccgcgacggccgcgacggccucaagggcgaccccggcccccccggccccaugggcccccccggcgagaugcccugcccccccggcaacgacggccuccccggcgcccccggcauccccggcgagugcggcgagaagggcgagcccggcgagcgcggcccccccggccuccccgcccaccucgacgaggagcuccaggccacccuccacgacuuccgccaccagauccuccagacccgcggcgcccucucccuccagggcuccaucaugaccgucggcgagaaggucuucuccuccaacggccaguccaucaccuucgacgccauccaggaggccugcgcccgcgccggcggccgcaucgccgucccccgcaaccccgaggagaacgaggccaucgccuccuucgucaagaaguacaacaccuacgccuacgucggccucaccgagggccccucccccggcgacuuccgcuacuccgacggcacccccgucaacuacaccaacugguaccgcggcgagcccgccggccgcggcaaggagcagugcgucgagauguacaccgacggccaguggaacgaccgcaacugccucuacucccgccucaccaucugcgaguucuga

SEQ ID NO: 9379 - RNA, 747 nt, Artificial Sequence
  derived and/or modified sequence opt3 from Surfactant_protein_A__Homo_sapiens__AAI11571
auguggcugugcccccucgcccuuaaccugaucuugauggcugcaagcggcgccgugugugaggucaaggacguuugcgugggguccccugguauuccaggaaccccgggcucucacggguuacccggaagagauggcagggacggucugaaaggggauccuggaccacccggcccuaugggcccacccggggaaaugccuuguccaccgggaaaugacggucuacccggcgcgccugggauaccaggagagugcggcgaaaagggugagcccggggaacggggaccuccaggccuccccgcucaucuggaugaggagcuucaggccacacugcacgacuuccgccaucaaaucuugcagacucgaggcgcacucucacugcaggggaguauuaugacgguaggagaaaaaguguuuagcuccaacggucagucuaucaccuucgaugccauucaagaggcuugugcacgugccggcgggagaaucgcugucccgaggaauccugaagagaacgaggccauagcgucguuugugaagaaauacaauacauaugcauacguuggacugacugaaggccccucaccaggugacuuccgguauagcgaugggaccccugugaacuacacaaauugguaucgcggcgagcccgccggaagaggcaaggaacagugcgucgagauguacaccgacgggcaguggaacgauaggaauugucucuauagucgguuaacuaucugcgaauuuuga

SEQ ID NO: 9380 - RNA, 747 nt, Artificial Sequence
  derived and/or modified sequence opt4 from Surfactant_protein_A__Homo_sapiens__AAI11571
auguggcugugcccccuggcccugaaccugauccugauggccgccagcggcgccgugugcgaggugaaggacgugugcgugggcagccccggcauccccggcacccccggcagccacggccugcccggcagagacggcagagacggccugaagggcgaccccggcccccccggccccaugggcccccccggcgagaugcccugcccccccggcaacgacggccugcccggcgcccccggcauccccggcgagugcggcgagaagggcgagcccggcgagagaggcccccccggccugcccgcccaccuggacgaggagcugcaggccacccugcacgacuucagacaccagauccugcagaccagaggcgcccugagccugcagggcagcaucaugaccgugggcgagaagguguucagcagcaacggccagagcaucaccuucgacgccauccaggaggccugcgccagagccggcggcagaaucgccgugcccagaaaccccgaggagaacgaggccaucgccagcuucgugaagaaguacaacaccuacgccuacgugggccugaccgagggccccagccccggcgacuucagauacagcgacggcacccccgugaacuacaccaacugguacagaggcgagcccgccggcagaggcaaggagcagugcguggagauguacaccgacggccaguggaacgacagaaacugccuguacagcagacugaccaucugcgaguucuga

SEQ ID NO: 9381 - RNA, 747 nt, Artificial Sequence
  derived and/or modified sequence opt5 from Surfactant_protein_A__Homo_sapiens__AAI11571
auguggcugugcccccucgcccugaaccuuauccugauggcugccagcggcgcggugugugaggucaaggacguuugcgugggguccccugggauuccgggcacccccgggucucacggacucccuggcagagaugggcgggacggacugaaaggcgaucccggcccucccgggccuaugggaccgcccggcgaaaugccuugucccccugggaaugacggacuucccggcgcuccggggaucccuggagagugcggcgaaaagggcgagcccggggaacgcggaccucccggccugcccgcccaucucgaugaggagcugcaggccacacugcacgacuucagacaucaaauucuccagacgcggggagcucugagccuucagggauccaucaugaccgugggcgaaaaagucuuuucuagcaacgggcaguccauuacauucgaugccauccaagaggcuugugcccgcgcgggaggcagaaucgccgugccucggaauccggaagagaacgaggcuauugccucuuuuguuaagaaauacaauaccuaugcuuacgugggccugacagaagggcccagcccuggagacuuccgcuauuccgauggcacccccgucaacuacacaaauugguauagaggggagccugccggacggggcaaggaacagugcguggagauguacaccgacgggcaguggaacgaucgcaauugucucuauagcagacugacgaucugcgaauuuuga

SEQ ID NO: 9382 - protein, 375 aa, Artificial Sequence
  Surfactant_protein_D__Homo_sapiens__P35247
MLLFLLSALVLLTQPLGYLEAEMKTYSHRTMPSACTLVMCSSVESGLPGRDGRDGREGPRGEKGDPGLPGAAGQAGMPGQAGPVGPKGDNGSVGEPGPKGDTGPSGPPGPPGVPGPAGREGPLGKQGNIGPQGKPGPKGEAGPKGEVGAPGMQGSAGARGLAGPKGERGVPGERGVPGNTGAAGSAGAMGPQGSPGARGPPGLKGDKGIPGDKGAKGESGLPDVASLRQQVEALQGQVQHLQAAFSQYKKVELFPNGQSVGEKIFKTAGFVKPFTEAQLLCTQAGGQLASPRSAAENAALQQLVVAKNEAAFLSMTDSKTEGKFTYPTGESLVYSNWAPGEPNDDGGSEDCVEIFTNGKWNDRACGEKRLVVCEF

SEQ ID NO: 9383 - RNA, 1128 nt, Artificial Sequence
  Surfactant_protein_D__Homo_sapiens__CCDS7362.1
augcugcucuuccuccucucugcacugguccugcucacacagccccugggcuaccuggaagcagaaaugaagaccuacucccacagaacaaugcccagugcuugcacccuggucauguguagcucaguggagaguggccugccuggucgcgauggacgggaugggagagagggcccucggggcgagaagggggacccagguuugccaggagcugcagggcaagcagggaugccuggacaagcuggcccaguugggcccaaaggggacaauggcucuguuggagaaccuggaccaaagggagacacugggccaaguggaccuccaggaccucccggugugccugguccagcuggaagagaagguccccuggggaagcaggggaacauaggaccucagggcaagccaggcccaaaaggagaagcugggcccaaaggagaaguaggugccccaggcaugcagggcucggcaggggcaagaggccucgcaggcccuaagggagagcgaggugucccuggugagcguggagucccuggaaacacaggggcagcagggucugcuggagccauggguccccagggaaguccaggugccaggggacccccgggauugaagggggacaaaggcauuccuggagacaaaggagcaaagggagaaagugggcuuccagauguugcuucucugaggcagcagguugaggccuuacagggacaaguacagcaccuccaggcugcuuucucucaguauaagaaaguugagcucuucccaaauggccaaagugucggggagaagauuuucaagacagcaggcuuuguaaaaccauuuacggaggcacagcugcugugcacacaggcugguggacaguuggccucuccacgcucugccgcugagaaugccgccuugcaacagcuggucguagcuaagaacgaggcugcuuuccugagcaugacugauuccaagacagagggcaaguucaccuaccccacaggagagucccuggucuauuccaacugggccccaggggagcccaacgaugauggcgggucagaggacuguguggagaucuucaccaauggcaaguggaaugacagggcuuguggagaaaagcgucuuguggucugcgaguucuga

SEQ ID NO: 9384 - RNA, 1128 nt, Artificial Sequence
  derived and/or modified sequence opt1 from Surfactant_protein_D__Homo_sapiens__CCDS7362.1
augcuccucuuccugcugagcgcccucgugcugcugacccagccccucggcuaccuggaggccgagaugaagaccuacucccaccgcacgaugccgagcgcgugcacccuggucaugugcuccagcguggaguccgggcuccccggccgggacgggcgcgacggccgggaggggccccgcggcgagaagggcgaccccgggcugccgggcgccgccgggcaggccggcaugcccgggcaggccggccccgugggccccaagggggacaacggcagcgucggggagccgggccccaagggcgacaccgggcccuccgggcccccggggccgcccggcgugcccgggcccgcgggccgggagggcccccuggggaagcagggcaacaucgggccccagggcaagcccgggccgaagggcgaggccggccccaagggggaggugggcgcccccgggaugcagggcagcgccggggcgcgcggccucgccggccccaagggggagcggggcgucccgggggagcgcggcgugcccggcaacaccggggccgccggcuccgccggggcgaugggcccccaggggagccccggcgcccggggcccgcccgggcugaagggcgacaaggggauccccggcgacaagggggccaagggcgaguccggccugccggacguggccagccuccgccagcaggucgaggcccugcagggccaggugcagcaccuccaggcggccuucucccaguacaagaagguggagcuguuccccaacggccagagcgucggggagaagaucuucaagacggccggcuucgugaagcccuucaccgaggcccagcugcugugcacccaggccgggggccagcuggcgagcccccgguccgccgccgagaacgccgcccugcagcagcugguggucgcgaagaacgaggccgccuuccucuccaugaccgacagcaagacggagggcaaguucaccuacccgaccggggagucccugguguacagcaacugggcccccggcgagcccaacgacgacgggggcagcgaggacugcguggagaucuucaccaacgggaaguggaacgaccgcgcgugcggcgagaagcggcuggucgugugcgaguucuga

SEQ ID NO: 9385 - RNA, 1128 nt, Artificial Sequence
  derived and/or modified sequence opt2 from Surfactant_protein_D__Homo_sapiens__CCDS7362.1
augcuccucuuccuccucuccgcccucguccuccucacccagccccucggcuaccucgaggccgagaugaagaccuacucccaccgcaccaugcccuccgccugcacccucgucaugugcuccuccgucgaguccggccuccccggccgcgacggccgcgacggccgcgagggcccccgcggcgagaagggcgaccccggccuccccggcgccgccggccaggccggcaugcccggccaggccggccccgucggccccaagggcgacaacggcuccgucggcgagcccggccccaagggcgacaccggccccuccggcccccccggcccccccggcguccccggccccgccggccgcgagggcccccucggcaagcagggcaacaucggcccccagggcaagcccggccccaagggcgaggccggccccaagggcgaggucggcgcccccggcaugcagggcuccgccggcgcccgcggccucgccggccccaagggcgagcgcggcguccccggcgagcgcggcguccccggcaacaccggcgccgccggcuccgccggcgccaugggcccccagggcucccccggcgcccgcggcccccccggccucaagggcgacaagggcauccccggcgacaagggcgccaagggcgaguccggccuccccgacgucgccucccuccgccagcaggucgaggcccuccagggccagguccagcaccuccaggccgccuucucccaguacaagaaggucgagcucuuccccaacggccaguccgucggcgagaagaucuucaagaccgccggcuucgucaagcccuucaccgaggcccagcuccucugcacccaggccggcggccagcucgccuccccccgcuccgccgccgagaacgccgcccuccagcagcucgucgucgccaagaacgaggccgccuuccucuccaugaccgacuccaagaccgagggcaaguucaccuaccccaccggcgagucccucgucuacuccaacugggcccccggcgagcccaacgacgacggcggcuccgaggacugcgucgagaucuucaccaacggcaaguggaacgaccgcgccugcggcgagaagcgccucgucgucugcgaguucuga

SEQ ID NO: 9386 - RNA, 1128 nt, Artificial Sequence
  derived and/or modified sequence opt3 from Surfactant_protein_D__Homo_sapiens__CCDS7362.1
augcuccuguuccuucugagcgccuugguguuacugacccagccccuaggcuaccucgaggcugaaaugaagacauauucccacagaacuaugccuucugcaugcacgcuggucauguguucaaguguugagagcgggcuuccaggaagggacggucgggauggccgcgaagggccgcgaggagagaaaggcgaccccggucugccuggggccgcgggacaagcuggcaugccaggccaggccgggcccgugggaccuaagggugauaacggcuccguaggggaaccaggacccaaaggcgacaccgguccuucugggccaccgggacccccuggcgugccaggccccgcagggcgugagggaccuuuggguaagcagggcaauaucgggccacagggaaaacccggcccgaagggugaggccgggccuaagggcgaagucggagcucccggcaugcaagggucggcaggagccagaggucucgcuggcccaaaaggggagaggggagugccuggcgaacgggguguucccgggaacacaggcgccgcgggaucagcaggcgccauggggccacagggaagccccggugcucgcggcccuccagggcugaagggagauaaaggcauuccgggugacaagggggccaaaggcgagaguggacugcccgauguggcaucccucagacagcaggucgaggcuuuacaaggccaggugcagcaucugcaggccgcguuuucucaauacaagaagguagaacuuuucccuaaugggcagagcguuggagagaaaauauuuaagacugccggcuucgugaaaccauuuaccgaagcacaguugcugugcacacaagcuggugggcagcuagccucccccaggucagcugccgagaacgcagcccuccagcagcuggucguggcuaagaaugaagcggcauuccuuaguaugaccgacagcaaaacugagggaaaguuuacauauccuaccggcgagucucugguguacuccaacugggccccaggugaacccaaugaugacggcgggucagaggauugugucgaaaucuucacgaacggaaaauggaaugaccgggcuugcggcgagaagcgcuugguugugugugaauuuuga

SEQ ID NO: 9387 - RNA, 1128 nt, Artificial Sequence
  derived and/or modified sequence opt4 from Surfactant_protein_D__Homo_sapiens__CCDS7362.1
augcugcuguuccugcugagcgcccuggugcugcugacccagccccugggcuaccuggaggccgagaugaagaccuacagccacagaaccaugcccagcgccugcacccuggugaugugcagcagcguggagagcggccugcccggcagagacggcagagacggcagagagggccccagaggcgagaagggcgaccccggccugcccggcgccgccggccaggccggcaugcccggccaggccggccccgugggccccaagggcgacaacggcagcgugggcgagcccggccccaagggcgacaccggccccagcggcccccccggcccccccggcgugcccggccccgccggcagagagggcccccugggcaagcagggcaacaucggcccccagggcaagcccggccccaagggcgaggccggccccaagggcgaggugggcgcccccggcaugcagggcagcgccggcgccagaggccuggccggccccaagggcgagagaggcgugcccggcgagagaggcgugcccggcaacaccggcgccgccggcagcgccggcgccaugggcccccagggcagccccggcgccagaggcccccccggccugaagggcgacaagggcauccccggcgacaagggcgccaagggcgagagcggccugcccgacguggccagccugagacagcagguggaggcccugcagggccaggugcagcaccugcaggccgccuucagccaguacaagaagguggagcuguuccccaacggccagagcgugggcgagaagaucuucaagaccgccggcuucgugaagcccuucaccgaggcccagcugcugugcacccaggccggcggccagcuggccagccccagaagcgccgccgagaacgccgcccugcagcagcuggugguggccaagaacgaggccgccuuccugagcaugaccgacagcaagaccgagggcaaguucaccuaccccaccggcgagagccugguguacagcaacugggcccccggcgagcccaacgacgacggcggcagcgaggacugcguggagaucuucaccaacggcaaguggaacgacagagccugcggcgagaagagacugguggugugcgaguucuga

SEQ ID NO: 9388 - RNA, 1128 nt, Artificial Sequence
  derived and/or modified sequence opt5 from Surfactant_protein_D__Homo_sapiens__CCDS7362.1
augcuccuguuccugcuuagcgcccuggugcuccugacccagccccuuggcuaccuggaggcugaaaugaagacauauucccacagaacgaugccuucugccugcacccucgucauguguagcuccguugagucugggcugccgggacgggacggccgcgaugggagagaaggaccccggggcgagaaaggggacccuggacugcccggcgcggcuggccaagccgggaugccuggacaggccggccccguggggccuaagggagauaacggcagcgugggggaaccgggacccaaaggcgacacaggcccuuccgggcccccuggacccccgggcgucccugggcccgcuggacgcgagggcccucucgggaagcagggaaauaucggcccccagggcaaacccgggccuaagggagaggccggcccgaagggggaagugggagcucccggcaugcaagggucugccggcgcgagaggacuggccggcccuaaaggggagcggggaguucccggcgaacgcggggugccuggaaacaccggcgcugccgggagcgcuggcgccaugggaccccagggcuccccgggggcgagaggaccucccggccuuaagggggauaaagggauuccuggcgacaagggggccaaaggcgagagcggacugcccgaugucgcuucucuccggcaacagguggaggcccugcagggccagguucagcaucuucaggcugccuuuucccaauacaagaagguggaacuguucccuaaugggcagagcgucggagagaaaaucuuuaagacagccggcuucgugaaacccuuuaccgaagcucagcuccugugcacacaagcgggaggacagcuggccucuccgcgcuccgcugccgagaacgccgcucuccagcagcugguggucgccaagaaugaagcggcuuuccuuagcaugaccgacucuaaaacggagggcaaguuuaccuauccuacaggggagucccugguuuacagcaacugggcccccggcgaacccaaugaugacggaggcuccgaggauuguguggaaauuuucaccaacgggaaauggaaugacagagccugcggagagaagcggcucguggucugugaauuuuga

SEQ ID NO: 9389 - protein, 606 aa, Artificial Sequence
  TAK1__Homo_sapiens__O43318
MSTASAASSSSSSSAGEMIEAPSQVLNFEEIDYKEIEVEEVVGRGAFGVVCKAKWRAKDVAIKQIESESERKAFIVELRQLSRVNHPNIVKLYGACLNPVCLVMEYAEGGSLYNVLHGAEPLPYYTAAHAMSWCLQCSQGVAYLHSMQPKALIHRDLKPPNLLLVAGGTVLKICDFGTACDIQTHMTNNKGSAAWMAPEVFEGSNYSEKCDVFSWGIILWEVITRRKPFDEIGGPAFRIMWAVHNGTRPPLIKNLPKPIESLMTRCWSKDPSQRPSMEEIVKIMTHLMRYFPGADEPLQYPCQYSDEGQSNSATSTGSFMDIASTNTSNKSDTNMEQVPATNDTIKRLESKLLKNQAKQQSESGRLSLGASRGSSVESLPPTSEGKRMSADMSEIEARIAATTAYSKPKRGHRKTASFGNILDVPEIVISGNGQPRRRSIQDLTVTGTEPGQVSSRSSSPSVRMITTSGPTSEKPTRSHPWTPDDSTDTNGSDNSIPMAYLTLDHQLQPLAPCPNSKESMAVFEQHCKMAQEYMKVQTEIALLLQRKQELVAELDQDEKDQQNTSRLVQEHKKLLDENKSLSTYYQQCKKQLEVIRSQQQKRQGTS

SEQ ID NO: 9390 - RNA, 1821 nt, Artificial Sequence
  TAK1__Homo_sapiens__ABC40734
augucuacagccucugccgccuccuccuccuccucgucuucggccggugagaugaucgaagccccuucccagguccucaacuuugaagagaucgacuacaaggagaucgagguggaagagguuguuggaagaggagccuuuggaguuguuugcaaagcuaaguggagagcaaaagauguugcuauuaaacaaauagaaagugaaucugagaggaaagcguuuauuguagagcuucggcaguuaucccgugugaaccauccuaauauuguaaagcuuuauggagccugcuugaauccagugugucuugugauggaauaugcugaagggggcucuuuauauaaugugcugcauggugcugaaccauugccauauuauacugcugcccacgcaaugaguugguguuuacaguguucccaaggaguggcuuaucuucacagcaugcaacccaaagcgcuaauucacagggaccugaaaccaccaaacuuacugcugguugcaggggggacaguucuaaaaauuugugauuuugguacagccugugacauucagacacacaugaccaauaacaaggggagugcugcuuggauggcaccugaaguuuuugaagguaguaauuacagugaaaaaugugacgucuucagcugggguauuauucuuugggaagugauaacgcgucggaaacccuuugaugagauugguggcccagcuuuccgaaucaugugggcuguucauaaugguacucgaccaccacugauaaaaaauuuaccuaagcccauugagagccugaugacucguuguuggucuaaagauccuucccagcgcccuucaauggaggaaauugugaaaauaaugacucacuugaugcgguacuuuccaggagcagaugagccauuacaguauccuugucaguauucagaugaaggacagagcaacucugccaccaguacaggcucauucauggacauugcuucuacaaauacgaguaacaaaagugacacuaauauggagcaaguuccugccacaaaugauacuauuaagcgcuuagaaucaaaauuguugaaaaaucaggcaaagcaacagagugaaucuggacguuuaagcuugggagccucccgugggagcaguguggagagcuugcccccaaccucugagggcaagaggaugagugcugacaugucugaaauagaagcuaggaucgccgcaaccacagccuauuccaagccuaaacggggccaccguaaaacugcuucauuuggcaacauucuggaugucccugagaucgucauaucaggcaacggacagccaagacguagauccauccaagacuugacuguaacuggaacagaaccuggucaggugagcaguaggucauccagucccagugucagaaugauuacuaccucaggaccaaccucagaaaagccaacucgaagucauccauggaccccugaugauuccacagauaccaauggaucagauaacuccaucccaauggcuuaucuuacacuggaucaccaacuacagccucuagcaccgugcccaaacuccaaagaaucuauggcaguguuugaacagcauuguaaaauggcacaagaauauaugaaaguucaaacagaaauugcauuguuauuacagagaaagcaagaacuaguugcagaacuggaccaggaugaaaaggaccagcaaaauacaucucgccugguacaggaacauaaaaagcuuuuagaugaaaacaaaagccuuucuacuuacuaccagcaaugcaaaaaacaacuagaggucaucagaagucagcagcagaaacgacaaggcacuucauga

SEQ ID NO: 9391 - RNA, 1821 nt, Artificial Sequence
  derived and/or modified sequence opt1 from TAK1__Homo_sapiens__ABC40734
augagcaccgccuccgccgcgagcuccagcuccagcuccagcgccggcgagaugaucgaggcccccucccaggugcugaacuucgaggagaucgacuacaaggagaucgaggucgaggaggugguggggcgcggcgccuucggggucgugugcaaggccaaguggcgggcgaaggacguggccaucaagcagaucgagagcgaguccgagcgcaaggccuucaucgucgagcuccggcagcugagccgcgugaaccacccgaacaucgugaagcuguacggcgccugccucaaccccgucugccuggugauggaguacgcggagggcgggucccuguacaacgugcuccacggcgccgagccccugcccuacuacaccgccgcccacgccaugagcuggugccugcagugcucccagggggucgcguaccuccacagcaugcagccgaaggcccugauccaccgggaccugaagccgcccaaccuccugcugguggccggcgggacggugcucaagaucugcgacuucggcaccgccugcgacauccagacccacaugaccaacaacaagggguccgccgcguggauggcccccgaggucuucgagggcagcaacuacuccgagaagugcgacguguucagcuggggcaucauccugugggaggugaucacgcgccggaagcccuucgacgagaucgggggccccgccuuccgcaucaugugggccguccacaacgggacccggccgccccugaucaagaaccuccccaagcccaucgagagccugaugacccgcugcugguccaaggaccccagccagcggcccuccauggaggagaucgugaagaucaugacccaccugaugcgcuacuucccgggcgccgacgagccccuccaguaccccugccaguacagcgacgagggccaguccaacagcgcgacguccaccgggagcuucauggacaucgccuccaccaacaccagcaacaaguccgacacgaacauggagcagguccccgccaccaacgacaccaucaagcggcuggagagcaagcugcucaagaaccaggccaagcagcaguccgagagcggccgccugucccugggggccagccggggcuccagcguggagucccucccgcccaccagcgaggggaagcgcaugagcgcggacauguccgagaucgaggcccggaucgccgccacgaccgcguacagcaagcccaagcgcggccaccggaagaccgccuccuucggcaacauccuggacgugcccgagaucgugaucagcgggaacggccagccgcgccggcgcuccauccaggaccugaccgucacggggaccgagcccggccaggugagcucccgcagcuccagccccuccguccggaugaucaccaccagcgggcccacguccgagaagccgacccgcagccaccccuggacccccgacgacuccaccgacacgaacggcagcgacaacuccaucccgauggccuaccucacccuggaccaccagcugcagccccucgcccccugccccaacagcaaggagagcauggccguguucgagcagcacugcaagauggcgcaggaguacaugaaggugcagaccgagaucgcccugcugcuccagcggaagcaggagcuggucgccgagcuggaccaggacgagaaggaccagcagaacaccucccgccucgugcaggagcacaagaagcugcuggacgagaacaagagccucuccacguacuaccagcagugcaagaagcagcuggaggugauccggagccagcagcagaagcgccagggcaccuccuga

SEQ ID NO: 9392 - RNA, 1821 nt, Artificial Sequence
  derived and/or modified sequence opt2 from TAK1__Homo_sapiens__ABC40734
auguccaccgccuccgccgccuccuccuccuccuccuccuccgccggcgagaugaucgaggcccccucccagguccucaacuucgaggagaucgacuacaaggagaucgaggucgaggaggucgucggccgcggcgccuucggcgucgucugcaaggccaaguggcgcgccaaggacgucgccaucaagcagaucgaguccgaguccgagcgcaaggccuucaucgucgagcuccgccagcucucccgcgucaaccaccccaacaucgucaagcucuacggcgccugccucaaccccgucugccucgucauggaguacgccgagggcggcucccucuacaacguccuccacggcgccgagccccuccccuacuacaccgccgcccacgccauguccuggugccuccagugcucccagggcgucgccuaccuccacuccaugcagcccaaggcccucauccaccgcgaccucaagccccccaaccuccuccucgucgccggcggcaccguccucaagaucugcgacuucggcaccgccugcgacauccagacccacaugaccaacaacaagggcuccgccgccuggauggcccccgaggucuucgagggcuccaacuacuccgagaagugcgacgucuucuccuggggcaucauccucugggaggucaucacccgccgcaagcccuucgacgagaucggcggccccgccuuccgcaucaugugggccguccacaacggcacccgccccccccucaucaagaaccuccccaagcccaucgagucccucaugacccgcugcugguccaaggaccccucccagcgccccuccauggaggagaucgucaagaucaugacccaccucaugcgcuacuuccccggcgccgacgagccccuccaguaccccugccaguacuccgacgagggccaguccaacuccgccaccuccaccggcuccuucauggacaucgccuccaccaacaccuccaacaaguccgacaccaacauggagcagguccccgccaccaacgacaccaucaagcgccucgaguccaagcuccucaagaaccaggccaagcagcaguccgaguccggccgccucucccucggcgccucccgcggcuccuccgucgagucccucccccccaccuccgagggcaagcgcauguccgccgacauguccgagaucgaggcccgcaucgccgccaccaccgccuacuccaagcccaagcgcggccaccgcaagaccgccuccuucggcaacauccucgacguccccgagaucgucaucuccggcaacggccagccccgccgccgcuccauccaggaccucaccgucaccggcaccgagcccggccaggucuccucccgcuccuccucccccuccguccgcaugaucaccaccuccggccccaccuccgagaagcccacccgcucccaccccuggacccccgacgacuccaccgacaccaacggcuccgacaacuccauccccauggccuaccucacccucgaccaccagcuccagccccucgcccccugccccaacuccaaggaguccauggccgucuucgagcagcacugcaagauggcccaggaguacaugaagguccagaccgagaucgcccuccuccuccagcgcaagcaggagcucgucgccgagcucgaccaggacgagaaggaccagcagaacaccucccgccucguccaggagcacaagaagcuccucgacgagaacaagucccucuccaccuacuaccagcagugcaagaagcagcucgaggucauccgcucccagcagcagaagcgccagggcaccuccuga

SEQ ID NO: 9393 - RNA, 1821 nt, Artificial Sequence
  derived and/or modified sequence opt3 from TAK1__Homo_sapiens__ABC40734
augagcaccgccuccgcugcaucuucaaguagcuccucuucggccggcgagaugaucgaagcgcccucacaggugcugaacuucgaggaaauugacuacaaggagauagaagucgaggagguuguggggagaggagcuuuugguguagugugcaaagccaaguggagggcaaaagaugucgccaucaagcaaauugaaagcgagagugaacggaaggcuuucaucguggagcuccgccagcuuucccgaguuaaucacccuaacauugugaaacuguauggcgcauguuugaauccagucugcuuagugauggaguacgccgaagggggaucucuguauaacguacuacauggcgcugagccgcuccccuacuauacagccgcgcacgcaaugagcuggugucugcagugcucccaggguguugccuaccuucauucaaugcaaccuaaggcucugauccaccgugacuugaaaccacccaaucuccugcugguggccgggggaacuguccucaagauaugugauuuuggcacggcaugcgacauccagacccauaugacaaacaauaaaggcagugcugccuggauggcgccugaaguguucgaggggagcaacuauucugaaaagugugauguguuuuccuggggaauuaucuuaugggaggucauuacuagaaggaaaccauucgacgagaucgguggccccgccuuucggauaaugugggcaguucacaaugggacccgcccuccacugauuaagaaccuuccgaagcccaucgaaucauugaugacaagaugcuggagcaaagauccuagucagaggccaucuauggaggaaauugugaagaucaugacccaccugaugcgguacuuccccggagcugacgagccucuacaguacccaugucaauauuccgaugaaggccagagcaauucggccacuucuacagguuccuuuauggacaucgcuucaaccaacacgaguaauaaaagcgauacuaacauggagcagguacccgccaccaaugacacaauuaagcgccucgaguccaaacugcuuaagaaccaggcaaaacaacagucugaaagcgggcgacugucauugggagccaguagaggcuccagcguggagucucucccgccuacuucagaaggcaagaggaugagugcugauaugagcgagauagaagcgcggaucgcagccaccacagcuuacuccaagcccaaacgugggcaucgcaagaccgccucuuucggaaacauucuggacgucccagagaucgugauaucggguaauggccagccuagaaggcggagcauucaagacuuaacgguuacugggacagagcccggacagguguccucacgaaguucuagcccauccguccgcaugaucaccacuucaggccccacaagcgaaaaaccuaccagaucucacccauggacgccggaugacuccaccgauacaaacgguagugacaauagcauccccauggcauaucugacucucgaucaucagcuucagccucuggccccaugccccaacucuaaggaguccauggcuguguuugaacaacacuguaaaauggcccaggaguacaugaagguacagaccgagauugcauugcuacugcagaggaagcaagaacucguugcggagcuggaccaggaugaaaaagaccagcagaauacaucacggcuugugcaagagcacaagaaacuguuggaugaaaacaagagucucagcacuuauuaccagcagugcaaaaagcagcuggaggucauccgcucgcaacagcagaagagacaagggaccuccuga

SEQ ID NO: 9394 - RNA, 1821 nt, Artificial Sequence
  derived and/or modified sequence opt4 from TAK1__Homo_sapiens__ABC40734
augagcaccgccagcgccgccagcagcagcagcagcagcagcgccggcgagaugaucgaggcccccagccaggugcugaacuucgaggagaucgacuacaaggagaucgagguggaggagguggugggcagaggcgccuucggcguggugugcaaggccaaguggagagccaaggacguggccaucaagcagaucgagagcgagagcgagagaaaggccuucaucguggagcugagacagcugagcagagugaaccaccccaacaucgugaagcuguacggcgccugccugaaccccgugugccuggugauggaguacgccgagggcggcagccuguacaacgugcugcacggcgccgagccccugcccuacuacaccgccgcccacgccaugagcuggugccugcagugcagccagggcguggccuaccugcacagcaugcagcccaaggcccugauccacagagaccugaagccccccaaccugcugcugguggccggcggcaccgugcugaagaucugcgacuucggcaccgccugcgacauccagacccacaugaccaacaacaagggcagcgccgccuggauggcccccgagguguucgagggcagcaacuacagcgagaagugcgacguguucagcuggggcaucauccugugggaggugaucaccagaagaaagcccuucgacgagaucggcggccccgccuucagaaucaugugggccgugcacaacggcaccagacccccccugaucaagaaccugcccaagcccaucgagagccugaugaccagaugcuggagcaaggaccccagccagagacccagcauggaggagaucgugaagaucaugacccaccugaugagauacuuccccggcgccgacgagccccugcaguaccccugccaguacagcgacgagggccagagcaacagcgccaccagcaccggcagcuucauggacaucgccagcaccaacaccagcaacaagagcgacaccaacauggagcaggugcccgccaccaacgacaccaucaagagacuggagagcaagcugcugaagaaccaggccaagcagcagagcgagagcggcagacugagccugggcgccagcagaggcagcagcguggagagccugccccccaccagcgagggcaagagaaugagcgccgacaugagcgagaucgaggccagaaucgccgccaccaccgccuacagcaagcccaagagaggccacagaaagaccgccagcuucggcaacauccuggacgugcccgagaucgugaucagcggcaacggccagcccagaagaagaagcauccaggaccugaccgugaccggcaccgagcccggccaggugagcagcagaagcagcagccccagcgugagaaugaucaccaccagcggccccaccagcgagaagcccaccagaagccaccccuggacccccgacgacagcaccgacaccaacggcagcgacaacagcauccccauggccuaccugacccuggaccaccagcugcagccccuggcccccugccccaacagcaaggagagcauggccguguucgagcagcacugcaagauggcccaggaguacaugaaggugcagaccgagaucgcccugcugcugcagagaaagcaggagcugguggccgagcuggaccaggacgagaaggaccagcagaacaccagcagacuggugcaggagcacaagaagcugcuggacgagaacaagagccugagcaccuacuaccagcagugcaagaagcagcuggaggugaucagaagccagcagcagaagagacagggcaccagcuga

SEQ ID NO: 9395 - RNA, 1821 nt, Artificial Sequence
  derived and/or modified sequence opt5 from TAK1__Homo_sapiens__ABC40734
augagcaccgccuccgcugccucuagcuccucuagcuccucugcgggcgagaugaucgaagcucccagccaggugcugaacuucgaggaaauugacuacaaggagaucgaagucgaggagguuguggggagaggagccuuuggcguggucugcaaagccaaguggcgggcuaaagauguggccauuaagcaaaucgaauccgagagcgaacgcaaggcuuucauuguugagcucagacagcugucucgggugaaucacccuaacaucgucaaacuuuauggggccugucugaauccggugugccucguuauggaguacgcggaaggaggcucccuguauaacgugcuucauggggccgagccccugccuuacuauacagcugcccacgcuaugagcuggugucuccagugcucucagggagucgccuaccugcauuccaugcaacccaaggcgcugauccaccgcgaccucaaaccucccaaucugcuucugguggccggcggcacggugcucaagauuugugauuuugggaccgcuugcgacauccagacacauaugaccaacaauaaaggaagcgccgcuuggauggccccugaagucuucgagggcucuaacuauuccgaaaagugugauguuuuuagcugggggauuauccugugggaggugauuacaagacggaaaccguucgacgagaucggaggccccgccuuucgcauuaugugggcugugcacaaugggaccagaccuccccuuaucaagaaccugccuaagcccaucgaaucccucaugacacggugcuggucuaaagauccgagccagcgcccuuccauggaggaaauugucaagaucaugacccaccugaugagauacuuccccggagcggacgagccucugcaguaccccugucaauauagcgaugaaggccagucuaauuccgccacgagcaccggcucuuuuauggacauugcuagcacaaacaccuccaauaaaucugauacaaacauggaacaggugcccgccaccaaugacacgaucaagcggcucgagagcaaacugcuuaagaaccaggccaaacaacaguccgagagcgggcgccugucucucggagcuuccagaggcagcucuguugagucccugccuccgacaagcgaagggaagcggauguccgccgauaugucugagauugaagcgcgcaucgcugccaccacagccuacagcaagcccaaaagaggacaucggaagaccgcuuccuucggcaacauccuugacgugccugagauugucaucucugggaauggacagcccagacgccggagcauucaagaccugaccgugacaggcacggagccuggccagguuuccagcagaucuuccagccccucugugcgcaugaucaccacauccgggccgaccagcgaaaaaccuacacggucucaccccuggaccccugaugacagcacggauacaaacggauccgacaauagcauucccauggccuaucucacccuggaucaucagcugcagccucucgcucccugcccgaacucuaaggaguccauggccgucuuugaacaacacuguaaaauggcgcaggaguacaugaaggugcagaccgagaucgcccugcuucugcagagaaagcaagaacucgucgcugagcuggaccaggaugaaaaagaccagcagaauacaagccgccuugugcaagagcacaagaaacugcucgaugaaaacaagucccugucuaccuauuaccagcagugcaaaaagcagcuggagguuauccggagccaacagcagaagagacaaggcacauccuga

SEQ ID NO: 9396 - protein, 596 aa, Artificial Sequence
  TAK1__Homo_sapiens__P49116
MTSPSPRIQIISTDSAVASPQRIQIVTDQQTGQKIQIVTAVDASGSPKQQFILTSPDGAGTGKVILASPETSSAKQLIFTTSDNLVPGRIQIVTDSASVERLLGKTDVQRPQVVEYCVVCGDKASGRHYGAVSCEGCKGFFKRSVRKNLTYSCRSNQDCIINKHHRNRCQFCRLKKCLEMGMKMESVQSERKPFDVQREKPSNCAASTEKIYIRKDLRSPLIATPTFVADKDGARQTGLLDPGMLVNIQQPLIREDGTVLLATDSKAETSQGALGTLANVVTSLANLSESLNNGDTSEIQPEDQSASEITRAFDTLAKALNTTDSSSSPSLADGIDTSGGGSIHVISRDQSTPIIEVEGPLLSDTHVTFKLTMPSPMPEYLNVHYICESASRLLFLSMHWARSIPAFQALGQDCNTSLVRACWNELFTLGLAQCAQVMSLSTILAAIVNHLQNSIQEDKLSGDRIKQVMEHIWKLQEFCNSMAKLDIDGYEYAYLKAIVLFSPDHPGLTSTSQIEKFQEKAQMELQDYVQKTYSEDTYRLARILVRLPALRLMSSNITEELFFTGLIGNVSIDSIIPYILKMETAEYNGQITGASL

SEQ ID NO: 9397 - RNA, 1791 nt, Artificial Sequence
  TAK1__Homo_sapiens__AAC50118
augaccagccccuccccacgcauccagauaaucuccaccgacucugcuguagccucaccucagcgcauucagauugucacagaccagcagacaggacagaaaauccagauagucaccgcaguggacgccuccggaucccccaaacagcaguucauccugaccagcccagauggagcuggaacugggaaggugauccuggcuuccccagagacauccagcgccaagcaacucauauucaccaccucagacaaccucgucccuggcaggauccagauugucacggauucugccucuguggagcguuuacuggggaagacggacguccagcggccccaggugguagaguacuguguggucuguggcgacaaagccuccggccgucacuauggggcugucaguugugaagguugcaaagguuucuucaaaaggagugugaggaaaaauuugaccuacagcugccggagcaaccaagacugcaucaucaauaaacaucaccggaaccgcugucaguuuugccggcugaaaaaaugcuuagagaugggcaugaaaauggaaucugugcagagugaacggaagcccuucgaugugcaacgggagaaaccaagcaauugugcugcuucaacugagaaaaucuauauccggaaagaccugagaaguccccugauagcuacucccacguuuguggcagacaaagauggagcaagacaaacaggucuucuugauccagggaugcuugugaacauccagcagccuuugauacgugaggaugguacaguucuccuggccacggauucuaaggcugaaacaagccagggagcucugggcacacuggcaaauguagugaccucccuugccaaccuaagugaaucuuugaacaacggugacacuucagaaauccagccagaggaccagucugcaagugagauaacucgggcauuugauaccuuagcuaaagcacuuaauaccacagacagcuccucuucuccaagcuuggcagaugggauagacaccaguggaggagggagcauccacgucaucagcagagaccagucgacacccaucauugagguugaaggcccccuccuuucagacacacacgucacauuuaagcuaacaaugcccaguccaaugccagaguaccucaacgugcacuacaucugugagucugcaucccgucugcuuuuccucucaaugcacugggcucggucaaucccagccuuucaggcacuugggcaggacugcaacaccagccuugugcgggccugcuggaaugagcucuucacccucggccuggcccagugugcccaggucaugagucucuccaccauccuggcugccauugucaaccaccugcagaacagcauccaggaagauaaacuuucuggugaccggauaaagcaagucauggagcacaucuggaagcugcaggaguucuguaacagcauggcgaagcuggauauagauggcuaugaguaugcauaccuuaaagcuauaguucucuuuagccccgaucauccagguuugaccagcacaagccagauugaaaaauuccaagaaaaggcacagauggaguugcaggacuauguucagaaaaccuacucagaagacaccuaccgauuggcccggauccucguucgccugccggcacucaggcugaugagcuccaacauaacagaagaacuuuuuuuuacuggucucauuggcaauguuucgauagacagcauaauccccuacauccucaagauggagacagcagaguauaauggccagaucaccggagccagucuauag

SEQ ID NO: 9398 - RNA, 1791 nt, Artificial Sequence
  derived and/or modified sequence opt1 from TAK1__Homo_sapiens__AAC50118
augaccagccccuccccgcgcauccagaucaucagcaccgacuccgccguggccagcccccagcggauccagaucgucacggaccagcagaccggccagaagauccagaucgugaccgcgguggacgccuccgggagccccaagcagcaguucauccugaccucccccgacggcgccgggacgggcaaggucauccucgccagcccggagaccuccagcgccaagcagcugaucuucaccaccuccgacaaccuggugcccgggcgcauccagaucgugacggacagcgcguccgucgagcggcuccugggcaagaccgacgugcagcgcccccagguggucgaguacugcguggugugcggcgacaaggccagcgggcggcacuacggcgccgucuccugcgaggggugcaagggcuucuucaagcgcagcgugcggaagaaccugaccuacuccugccgcagcaaccaggacugcaucaucaacaagcaccaccggaaccgcugccaguucugccggcucaagaagugccuggagauggggaugaagauggaguccgugcagagcgagcgcaagcccuucgacguccagcgggagaagccgagcaacugcgccgcguccaccgagaagaucuacauccgcaaggaccugcggagcccccucaucgccacgcccaccuucguggccgacaaggacggcgcccgccagaccggccugcuggaccccgggaugcucgugaacauccagcagccgcugauccgggaggacggcaccguccugcucgccacggacuccaaggcggagaccagccagggggcccugggcacccuggccaacguggugaccucccucgccaaccugagcgagucccugaacaacggcgacacgagcgagauccagcccgaggaccaguccgccagcgagaucacccgcgcguucgacacccucgccaaggcccugaacaccacggacuccagcuccagccccucccuggccgacgggaucgacaccagcggcgggggcuccauccacgucaucagccgggaccaguccacccccaucaucgagguggaggggccgcuccugagcgacacccacgugacguucaagcugaccaugcccagccccaugcccgaguaccucaacguccacuacaucugcgaguccgccagccgccugcuguuccucuccaugcacugggcgcggagcaucccggccuuccaggcccugggccaggacugcaacaccucccuggugcgcgccugcuggaacgagcuguucacccugggccuggcccagugcgcgcaggucaugagccucuccacgauccuggccgccaucgugaaccaccuccagaacagcauccaggaggacaagcucuccggggaccgcaucaagcaggucauggagcacaucuggaagcugcaggaguucugcaacagcauggccaagcuggacaucgacggcuacgaguacgcguaccucaaggccaucgugcuguucucccccgaccaccccgggcugaccagcaccucccagaucgagaaguuccaggagaaggcccagauggagcuccaggacuacgugcagaagaccuacagcgaggacacguaccggcuggcccgcauccuggugcggcuccccgcccugcgccugauguccagcaacaucaccgaggagcuguucuucaccggccucaucgggaacgucuccaucgacagcaucaucccguacauccugaagauggagaccgcggaguacaacggccagaucaccggcgccagccuguga

SEQ ID NO: 9399 - RNA, 1791 nt, Artificial Sequence
  derived and/or modified sequence opt2 from TAK1__Homo_sapiens__AAC50118
augaccucccccuccccccgcauccagaucaucuccaccgacuccgccgucgccuccccccagcgcauccagaucgucaccgaccagcagaccggccagaagauccagaucgucaccgccgucgacgccuccggcucccccaagcagcaguucauccucaccucccccgacggcgccggcaccggcaaggucauccucgccucccccgagaccuccuccgccaagcagcucaucuucaccaccuccgacaaccucguccccggccgcauccagaucgucaccgacuccgccuccgucgagcgccuccucggcaagaccgacguccagcgcccccaggucgucgaguacugcgucgucugcggcgacaaggccuccggccgccacuacggcgccgucuccugcgagggcugcaagggcuucuucaagcgcuccguccgcaagaaccucaccuacuccugccgcuccaaccaggacugcaucaucaacaagcaccaccgcaaccgcugccaguucugccgccucaagaagugccucgagaugggcaugaagauggaguccguccaguccgagcgcaagcccuucgacguccagcgcgagaagcccuccaacugcgccgccuccaccgagaagaucuacauccgcaaggaccuccgcuccccccucaucgccacccccaccuucgucgccgacaaggacggcgcccgccagaccggccuccucgaccccggcaugcucgucaacauccagcagccccucauccgcgaggacggcaccguccuccucgccaccgacuccaaggccgagaccucccagggcgcccucggcacccucgccaacgucgucaccucccucgccaaccucuccgagucccucaacaacggcgacaccuccgagauccagcccgaggaccaguccgccuccgagaucacccgcgccuucgacacccucgccaaggcccucaacaccaccgacuccuccuccucccccucccucgccgacggcaucgacaccuccggcggcggcuccauccacgucaucucccgcgaccaguccacccccaucaucgaggucgagggcccccuccucuccgacacccacgucaccuucaagcucaccaugcccucccccaugcccgaguaccucaacguccacuacaucugcgaguccgccucccgccuccucuuccucuccaugcacugggcccgcuccauccccgccuuccaggcccucggccaggacugcaacaccucccucguccgcgccugcuggaacgagcucuucacccucggccucgcccagugcgcccaggucaugucccucuccaccauccucgccgccaucgucaaccaccuccagaacuccauccaggaggacaagcucuccggcgaccgcaucaagcaggucauggagcacaucuggaagcuccaggaguucugcaacuccauggccaagcucgacaucgacggcuacgaguacgccuaccucaaggccaucguccucuucucccccgaccaccccggccucaccuccaccucccagaucgagaaguuccaggagaaggcccagauggagcuccaggacuacguccagaagaccuacuccgaggacaccuaccgccucgcccgcauccucguccgccuccccgcccuccgccucauguccuccaacaucaccgaggagcucuucuucaccggccucaucggcaacgucuccaucgacuccaucauccccuacauccucaagauggagaccgccgaguacaacggccagaucaccggcgccucccucuga

SEQ ID NO: 9400 - RNA, 1791 nt, Artificial Sequence
  derived and/or modified sequence opt3 from TAK1__Homo_sapiens__AAC50118
augaccagccccuccccuagaauccagauuauaucuacagacucagccguggcuaguccacaaaggauccagauugucacugaucagcagacgggccaaaagauccagauuguuaccgcaguggacgccagcggguccccgaaacagcaguucauccugacaucucccgauggagcggguacuggcaagguaauacucgcuucgccugagaccucaagcgccaaacaacuuaucuuuacaaccagugacaaccuggugccagggcggauucagaucgucacugauuccgcaucuguggaacgcuuguuaggaaagacagacguucagcgaccccagguggucgaguacugcgugguauguggcgauaaagccagcggucgucacuauggggcuguuuccugcgaaggauguaagggcuucuuuaagagaucagugaggaaaaaucugaccuacaguugccggagcaaccaagacuguauuaucaauaagcaucaccgcaacagaugccaguucuguaggcuuaaaaagugccucgagaugggcaugaaaauggaaucuguccaguccgagcggaagccuuuugaugugcaacgcgagaagccaucaaauugugcagccagcacggagaaaauauauauucgaaaggaccugagaaguccccuuaucgcuacuccuaccuucguggccgauaaagacggggcgaggcagacaggacuguuggauccagguaugcucgucaacauucagcagccgcugauccgggaagacggcacuguucugcucgcaaccgacucuaaggccgaaacaucccaaggggcuuuaggaacccuggccaaugugguaacgagccuugcaaacuugucggagucucugaauaacggcgauacuuccgagauccagcccgaagaccagucagcuagugagauuacacgugccuuugauacccuagcgaaagcccucaauacuacagacagcuccucuagcccuucacuggcagaugguauagacaccagugggggaggcuccauccaugugauuagccgcgaucagucuacgccaaucauagaagucgagggcccccuucugucagacacccacgugacauucaaguugacuaugccuaguccaaugcccgaauaccucaacguucauuauauuugcgagagcgcuuccagacuguuauuucugucuaugcacugggccaggucgaucccggcuuuccaagcccucgggcaggauuguaauaccagccuugugcgggcaugcuggaacgagcuguuuacauugggacuagcccagugcgcucaggucaugucccugucaacuauccucgcggcaauugugaaucaucugcaaaacaguauccaggaagacaaacuuucuggugaucgaauuaagcagguaauggagcacauauggaagcugcaggaguucuguaacagcauggccaaauuggacaucgacggcuacgaauaugcuuaccucaaggccauuguucuguuuuccccugaucaccccggguuaaccucaacaagccaaaucgaaaaauuccaggagaaggcacagauggagcugcaagacuacgugcagaaaaccuauucugaagauacuuaccgccuagccagaauccucgucaggcugccagcucuacgguugauguccaguaauauuacggaggaacuguucuuuacaggacucauaggcaacgugagcaucgacucuauuaucccuuauauucugaagauggagaccgccgaauacaauggucagaucacuggggcaucccuuuga

SEQ ID NO: 9401 - RNA, 1791 nt, Artificial Sequence
  derived and/or modified sequence opt4 from TAK1__Homo_sapiens__AAC50118
augaccagccccagccccagaauccagaucaucagcaccgacagcgccguggccagcccccagagaauccagaucgugaccgaccagcagaccggccagaagauccagaucgugaccgccguggacgccagcggcagccccaagcagcaguucauccugaccagccccgacggcgccggcaccggcaaggugauccuggccagccccgagaccagcagcgccaagcagcugaucuucaccaccagcgacaaccuggugcccggcagaauccagaucgugaccgacagcgccagcguggagagacugcugggcaagaccgacgugcagagaccccaggugguggaguacugcguggugugcggcgacaaggccagcggcagacacuacggcgccgugagcugcgagggcugcaagggcuucuucaagagaagcgugagaaagaaccugaccuacagcugcagaagcaaccaggacugcaucaucaacaagcaccacagaaacagaugccaguucugcagacugaagaagugccuggagaugggcaugaagauggagagcgugcagagcgagagaaagcccuucgacgugcagagagagaagcccagcaacugcgccgccagcaccgagaagaucuacaucagaaaggaccugagaagcccccugaucgccacccccaccuucguggccgacaaggacggcgccagacagaccggccugcuggaccccggcaugcuggugaacauccagcagccccugaucagagaggacggcaccgugcugcuggccaccgacagcaaggccgagaccagccagggcgcccugggcacccuggccaacguggugaccagccuggccaaccugagcgagagccugaacaacggcgacaccagcgagauccagcccgaggaccagagcgccagcgagaucaccagagccuucgacacccuggccaaggcccugaacaccaccgacagcagcagcagccccagccuggccgacggcaucgacaccagcggcggcggcagcauccacgugaucagcagagaccagagcacccccaucaucgagguggagggcccccugcugagcgacacccacgugaccuucaagcugaccaugcccagccccaugcccgaguaccugaacgugcacuacaucugcgagagcgccagcagacugcuguuccugagcaugcacugggccagaagcauccccgccuuccaggcccugggccaggacugcaacaccagccuggugagagccugcuggaacgagcuguucacccugggccuggcccagugcgcccaggugaugagccugagcaccauccuggccgccaucgugaaccaccugcagaacagcauccaggaggacaagcugagcggcgacagaaucaagcaggugauggagcacaucuggaagcugcaggaguucugcaacagcauggccaagcuggacaucgacggcuacgaguacgccuaccugaaggccaucgugcuguucagccccgaccaccccggccugaccagcaccagccagaucgagaaguuccaggagaaggcccagauggagcugcaggacuacgugcagaagaccuacagcgaggacaccuacagacuggccagaauccuggugagacugcccgcccugagacugaugagcagcaacaucaccgaggagcuguucuucaccggccugaucggcaacgugagcaucgacagcaucauccccuacauccugaagauggagaccgccgaguacaacggccagaucaccggcgccagccuguga

SEQ ID NO: 9402 - RNA, 1791 nt, Artificial Sequence
  derived and/or modified sequence opt5 from TAK1__Homo_sapiens__AAC50118
augaccagccccuccccuagaauccagauuaucucuacagacagcgccguggcuuccccgcaacggauucagaucgucacggaucagcagaccggccaaaagauucagaucguuacagccguggacgcgucugggagccccaaacagcaguucauccugaccuccccugauggagcuggcacagggaaggugauucucgccucucccgagaccagcuccgccaaacaacugaucuuuacaaccagcgacaaccuugucccuggacgcauucagaucgugacggauucugcuuccguugaaagacugcucggcaagaccgacgugcagcggccccaggucguggaguacugcguuguguguggggauaaagccagcggacgccacuauggcgcugucucuugcgaaggcuguaagggguucuuuaagagauccgugcggaaaaaucugacauacagcugccgcucuaaccaagacuguauuaucaauaagcaucacagaaaccggugccaguucugucgccuuaaaaagugccuggagaugggaaugaaaauggaauccgugcagagcgagagaaagccuuuugauguccaacgggagaagccguccaauugugccgcgucuaccgaaaagauuuauauccgcaaggaccucagaagcccccugaucgccacaccuaccuucguugcugauaaagacggcgcccggcagacggggcugcucgaucccggaaugcuggugaacauucagcagccucuuauccgcgaggacggcacagugcugcucgcuaccgacuccaaggccgaaacaagccaaggggcgcugggaacccuugccaaugucgugaccucucuggcuaaccucuccgagagccugaauaacggcgauacaucugagauucagcccgaagaccagagcgccuccgagaucacgagagcuuuugauacccuggccaaagcccucaauacaaccgacucuagcuccagcccgucucuggcugauggcauugacacauccgggggaggcagcauccauguuaucucucgggaucaguccaccccuauuaucgaaguggaggggccccuucugagcgacacgcacgucacauucaagcucaccaugccuucccccaugcccgaauaccugaacgugcauuauauuugcgagucugcgagcagacuucuguuucucuccaugcacugggcccgcucuaucccugcuuuccaagcccugggacaggauuguaauaccagccugguucgggccugcuggaacgagcucuuuacacugggccuugcucagugcgcccaggugaugucccugagcaccauucucgcggcuaucgucaaucaucugcaaaacucuauccaggaagacaaacuuuccggggauagaauuaaacaggugauggagcacaucuggaagcugcaggaguucuguaacagcauggccaaacucgacauugacggauacgaauaugccuaccugaaggcuaucguccuguuuucuccggaucaccccggccucacauccacgagccaaauugaaaaauuccaggagaaggcccagauggagcugcaagacuacgugcagaaaaccuauucugaagauacauaccgccuugcucggauccugguuagacucccugcccugcgccugaugagcuccaauauuaccgaggaacuuuucuuuacaggccucaucgggaacgugagcaucgacucuauuauccccuauauucugaagauggagaccgcggaauacaauggacagaucacgggcgccucccuguga

SEQ ID NO: 9403 - protein, 729 aa, Artificial Sequence
  TBK1__Homo_sapiens__Q9UHD2
MQSTSNHLWLLSDILGQGATANVFRGRHKKTGDLFAIKVFNNISFLRPVDVQMREFEVLKKLNHKNIVKLFAIEEETTTRHKVLIMEFCPCGSLYTVLEEPSNAYGLPESEFLIVLRDVVGGMNHLRENGIVHRDIKPGNIMRVIGEDGQSVYKLTDFGAARELEDDEQFVSLYGTEEYLHPDMYERAVLRKDHQKKYGATVDLWSIGVTFYHAATGSLPFRPFEGPRRNKEVMYKIITGKPSGAISGVQKAENGPIDWSGDMPVSCSLSRGLQVLLTPVLANILEADQEKCWGFDQFFAETSDILHRMVIHVFSLQQMTAHKIYIHSYNTATIFHELVYKQTKIISSNQELIYEGRRLVLEPGRLAQHFPKTTEENPIFVVSREPLNTIGLIYEKISLPKVHPRYDLDGDASMAKAITGVVCYACRIASTLLLYQELMRKGIRWLIELIKDDYNETVHKKTEVVITLDFCIRNIEKTVKVYEKLMKINLEAAELGEISDIHTKLLRLSSSQGTIETSLQDIDSRLSPGGSLADAWAHQEGTHPKDRNVEKLQVLLNCMTEIYYQFKKDKAERRLAYNEEQIHKFDKQKLYYHATKAMTHFTDECVKKYEAFLNKSEEWIRKMLHLRKQLLSLTNQCFDIEEEVSKYQEYTNELQETLPQKMFTASSGIKHTMTPIYPSSNTLVEMTLGMKKLKEEMEGVVKELAENNHILERFGSLTMDGGLRNVDCL

SEQ ID NO: 9404 - RNA, 2190 nt, Artificial Sequence
  TBK1__Homo_sapiens__AAF05989
augcagagcacuucuaaucaucuguggcuuuuaucugauauuuuaggccaaggagcuacugcaaaugucuuucguggaagacauaagaaaacuggugauuuauuugcuaucaaaguauuuaauaacauaagcuuccuucguccaguggauguucaaaugagagaauuugaaguguugaaaaaacucaaucacaaaaauauugucaaauuauuugcuauugaagaggagacaacaacaagacauaaaguacuuauuauggaauuuuguccaugugggaguuuauacacuguuuuagaagaaccuucuaaugccuauggacuaccagaaucugaauucuuaauuguuuugcgagaugugguggguggaaugaaucaucuacgagagaaugguauagugcaccgugauaucaagccaggaaauaucaugcguguuauaggggaagauggacagucuguguacaaacucacagauuuuggugcagcuagagaauuagaagaugaugagcaguuuguuucucuguauggcacagaagaauauuugcacccugauauguaugagagagcagugcuaagaaaagaucaucagaagaaauauggagcaacaguugaucuuuggagcauugggguaacauuuuaccaugcagcuacuggaucacugccauuuagacccuuugaagggccucguaggaauaaagaagugauguauaaaauaauuacaggaaagccuucuggugcaauaucuggaguacagaaagcagaaaauggaccaauugacuggaguggagacaugccuguuucuugcagucuuucucggggucuucagguucuacuuaccccuguucuugcaaacauccuugaagcagaucaggaaaaguguugggguuuugaccaguuuuuugcagaaacuagugauauacuucaccgaaugguaauucauguuuuuucgcuacaacaaaugacagcucauaagauuuauauucauagcuauaauacugcuacuauauuucaugaacugguauauaaacaaaccaaaauuauuucuucaaaucaagaacuuaucuacgaagggcgacgcuuagucuuagaaccuggaaggcuggcacaacauuucccuaaaacuacugaggaaaacccuauauuuguaguaagccgggaaccucugaauaccauaggauuaauauaugaaaaaauuucccucccuaaaguacauccacguuaugauuuagacggggaugcuagcauggcuaaggcaauaacagggguuguguguuaugccugcagaauugccaguaccuuacugcuuuaucaggaauuaaugcgaaaggggauacgauggcugauugaauuaauuaaagaugauuacaaugaaacuguucacaaaaagacagaaguugugaucacauuggauuucuguaucagaaacauugaaaaaacugugaaaguauaugaaaaguugaugaagaucaaccuggaagcggcagaguuaggugaaauuucagacauacacaccaaauuguugagacuuuccaguucucagggaacaauagaaaccagucuucaggauaucgacagcagauuaucuccagguggaucacuggcagacgcaugggcacaucaagaaggcacucauccgaaagacagaaauguagaaaaacuacaaguccuguuaaauugcaugacagagauuuacuaucaguucaaaaaagacaaagcagaacguagauuagcuuauaaugaagaacaaauccacaaauuugauaagcaaaaacuguauuaccaugccacaaaagcuaugacgcacuuuacagaugaauguguuaaaaaguaugaggcauuuuugaauaagucagaagaauggauaagaaagaugcuucaucuuaggaaacaguuauuaucgcugacuaaucaguguuuugauauugaagaagaaguaucaaaauaucaagaauauacuaaugaguuacaagaaacucugccucagaaaauguuuacagcuuccaguggaaucaaacauaccaugaccccaauuuauccaaguucuaacacauuaguagaaaugacucuugguaugaagaaauuaaaggaagagauggaaggggugguuaaagaacuugcugaaaauaaccacauuuuagaaagguuuggcucuuuaaccauggaugguggccuucgcaacguugacugucuuuag

SEQ ID NO: 9405 - RNA, 2190 nt, Artificial Sequence
  derived and/or modified sequence opt1 from TBK1__Homo_sapiens__AAF05989
augcagagcaccuccaaccaccuguggcuccugagcgacauccugggccagggggccaccgccaacguguuccgcggccggcacaagaagacgggggaccucuucgcgaucaaggucuucaacaacaucuccuuccugcgccccguggacgugcagaugcgggaguucgagguccugaagaagcucaaccacaagaacaucgugaagcuguucgccaucgaggaggagaccaccacccgccacaaggugcugaucauggaguucugcccgugcggcagccucuacacgguccuggaggagcccuccaacgccuacgggcugcccgagagcgaguuccucaucgugcugcgggacguggucggcggcaugaaccaccuccgcgagaacgggaucgugcaccgggacaucaagcccggcaacaucaugcgcgugaucggggaggacggccaguccgucuacaagcugaccgacuucggggccgcccgggagcuggaggacgacgagcaguucgugagccuguacggcaccgaggaguaccuccacccggacauguacgagcgcgcggugcugcggaaggaccaccagaagaaguacggcgccaccgucgaccugugguccaucggggugacguucuaccacgccgccaccggcagccuccccuuccgccccuucgaggggccccggcgcaacaaggaggugauguacaagaucaucaccggcaagccguccggcgcgaucagcgggguccagaaggccgagaacggccccaucgacugguccggggacaugcccgugagcugcucccugagccggggccuccaggugcugcugacccccguccuggccaacauccucgaggccgaccaggagaagugcuggggguucgaccaguucuucgccgagacguccgacauccugcaccgcauggugauccacguguucagccugcagcagaugaccgcgcacaagaucuacauccacuccuacaacaccgccaccaucuuccacgagcucgucuacaagcagacgaagaucaucagcagcaaccaggagcugaucuacgagggccggcgccuggugcucgagccgggccggcuggcccagcacuuccccaagaccaccgaggagaaccccaucuucgucgugucccgcgagccccugaacaccaucgggcucaucuacgagaagaucagccugccgaaggugcacccccgguacgaccuggacggcgacgccuccauggccaaggcgaucacgggggucgugugcuacgccugccgcaucgccagcacccuccugcuguaccaggagcucaugcgcaagggcauccgguggcugaucgagcugaucaaggacgacuacaacgagaccgugcacaagaagaccgaggucgugaucacgcucgacuucugcauccgcaacaucgagaagaccgugaaggucuacgagaagcugaugaagaucaaccuggaggccgccgagcucggggagaucuccgacauccacaccaagcugcugcggcugagcuccagccagggcaccaucgagacgucccuccaggacaucgacagccgccugucccccggcgggagccuggcggacgccugggcccaccaggagggcacccaccccaaggaccggaacguggagaagcuccaggugcugcugaacugcaugaccgagaucuacuaccaguucaagaaggacaaggccgagcgccggcucgccuacaacgaggagcagauccacaaguucgacaagcagaagcuguacuaccacgcgaccaaggccaugacgcacuucaccgacgagugcgucaagaaguacgaggccuuccugaacaaguccgaggaguggauccgcaagaugcuccaccuccggaagcagcugcugagccugaccaaccagugcuucgacaucgaggaggagguguccaaguaccaggaguacaccaacgagcugcaggagacgcucccgcagaagauguucaccgccagcuccgggaucaagcacaccaugacccccaucuaccccagcuccaacacccugguggagaugacgcugggcaugaagaagcucaaggaggagauggagggggucgugaaggagcuggcggagaacaaccacauccuggagcgcuucggcagccucaccauggacggcgggcugcggaacguggacugccuguga

SEQ ID NO: 9406 - RNA, 2190 nt, Artificial Sequence
  derived and/or modified sequence opt2 from TBK1__Homo_sapiens__AAF05989
augcaguccaccuccaaccaccucuggcuccucuccgacauccucggccagggcgccaccgccaacgucuuccgcggccgccacaagaagaccggcgaccucuucgccaucaaggucuucaacaacaucuccuuccuccgccccgucgacguccagaugcgcgaguucgagguccucaagaagcucaaccacaagaacaucgucaagcucuucgccaucgaggaggagaccaccacccgccacaagguccucaucauggaguucugccccugcggcucccucuacaccguccucgaggagcccuccaacgccuacggccuccccgaguccgaguuccucaucguccuccgcgacgucgucggcggcaugaaccaccuccgcgagaacggcaucguccaccgcgacaucaagcccggcaacaucaugcgcgucaucggcgaggacggccaguccgucuacaagcucaccgacuucggcgccgcccgcgagcucgaggacgacgagcaguucgucucccucuacggcaccgaggaguaccuccaccccgacauguacgagcgcgccguccuccgcaaggaccaccagaagaaguacggcgccaccgucgaccucugguccaucggcgucaccuucuaccacgccgccaccggcucccuccccuuccgccccuucgagggcccccgccgcaacaaggaggucauguacaagaucaucaccggcaagcccuccggcgccaucuccggcguccagaaggccgagaacggccccaucgacugguccggcgacaugcccgucuccugcucccucucccgcggccuccagguccuccucacccccguccucgccaacauccucgaggccgaccaggagaagugcuggggcuucgaccaguucuucgccgagaccuccgacauccuccaccgcauggucauccacgucuucucccuccagcagaugaccgcccacaagaucuacauccacuccuacaacaccgccaccaucuuccacgagcucgucuacaagcagaccaagaucaucuccuccaaccaggagcucaucuacgagggccgccgccucguccucgagcccggccgccucgcccagcacuuccccaagaccaccgaggagaaccccaucuucgucgucucccgcgagccccucaacaccaucggccucaucuacgagaagaucucccuccccaagguccacccccgcuacgaccucgacggcgacgccuccauggccaaggccaucaccggcgucgucugcuacgccugccgcaucgccuccacccuccuccucuaccaggagcucaugcgcaagggcauccgcuggcucaucgagcucaucaaggacgacuacaacgagaccguccacaagaagaccgaggucgucaucacccucgacuucugcauccgcaacaucgagaagaccgucaaggucuacgagaagcucaugaagaucaaccucgaggccgccgagcucggcgagaucuccgacauccacaccaagcuccuccgccucuccuccucccagggcaccaucgagaccucccuccaggacaucgacucccgccucucccccggcggcucccucgccgacgccugggcccaccaggagggcacccaccccaaggaccgcaacgucgagaagcuccagguccuccucaacugcaugaccgagaucuacuaccaguucaagaaggacaaggccgagcgccgccucgccuacaacgaggagcagauccacaaguucgacaagcagaagcucuacuaccacgccaccaaggccaugacccacuucaccgacgagugcgucaagaaguacgaggccuuccucaacaaguccgaggaguggauccgcaagaugcuccaccuccgcaagcagcuccucucccucaccaaccagugcuucgacaucgaggaggaggucuccaaguaccaggaguacaccaacgagcuccaggagacccucccccagaagauguucaccgccuccuccggcaucaagcacaccaugacccccaucuaccccuccuccaacacccucgucgagaugacccucggcaugaagaagcucaaggaggagauggagggcgucgucaaggagcucgccgagaacaaccacauccucgagcgcuucggcucccucaccauggacggcggccuccgcaacgucgacugccucuga

SEQ ID NO: 9407 - RNA, 2190 nt, Artificial Sequence
  derived and/or modified sequence opt3 from TBK1__Homo_sapiens__AAF05989
augcagagcaccuccaaccaccuguggcuccuuucugacauccugggccaaggggccacagcuaauguguucagaggaaggcauaagaaaacuggugauuuguuugcaauuaaggucuucaacaauauaucauuuuuacggcccguugacgugcagaugcgcgaguucgaaguacugaaaaagcuaaaccacaaaaauaucgugaagcucuuugccauugaggaagagacgaccacacgacauaagguccugaucauggaguucugcccuuguggcagucuuuacacugugcuggaggagccaagcaacgcguauggguugccggaauccgaguuucucauuguucugcgugauguggucggaggcaugaaucaccugagagaaaacgguaucgugcauagggacauaaaacccgggaauaucaugcggguaauuggagaggauggccagucuguuuacaagcucaccgacuucggcgcugcccgcgaguuagaagaugacgagcaguuugugucgcuguaugggacagaagaguaccuucacccugauauguaugaaagagcagucuugaggaaagaccaccaaaagaaauacggagccaccguggaucuguggucaaucggugugacuuucuaucaugcugcaacaggcagccuaccauuucggcccuucgaggggccucgccgaaacaaggaggucauguacaagauuaucaccggaaaaccaaguggcgccauauccgguguucagaaggcugaaaaugggcccauugacuggucuggagauaugccugugagcugcucccucucaagaggccugcagguacuucugacgccaguguuggccaacauccucgaggcggaccaggaaaaauguuggggcuuugaccaauucuucgcagagaccagugauauucugcacaggauggucauccauguguuuagcuuacagcagaugacugcccacaagaucuacauucacucuuauaauacagcuacuauauuccaugaacugguuuacaaacagaccaagaucauuuccucaaaccaagagcucaucuaugaggggcggcgucuugugcuggaaccgggacgcuuggcccagcacuuucccaaaacaaccgaggaaaauccuauauucgucgugagcagagagccacuaaacacgauuggucugaucuacgaaaagaucagucuccccaagguacauccuagguaugaccuggauggcgacgcaucuauggcuaaagccauuacugggguugugugcuacgcgugucggaucgccuccacacuucuguuguaucaggagcucaugcgaaagggcauucgcuggcugauagaguuaaucaaagaugacuacaacgaaaccguccacaagaaaacugagguggucauuacacuggauuuuugcaucagaaauaucgaaaagaccgugaagguuuacgagaaacuaaugaagauuaaccucgaggcagcugaacugggagagauaagcgacauccauacgaaacuuuugaggcugucgucuucccaagguaccauugaaacaucacuccaggauaucgacagucggcugagcccagggggcucccuugccgaugcuugggcccaccaggagggaacucaccccaaggaccgcaauguggaaaaacugcagguauugcucaacuguaugaccgagauuuauuaccaauucaagaaggacaaagcagagagaaggcuggccuauaaugaagaacagauccauaaguuugauaaacagaaguuauacuaucacgcuacaaaagcgaugacucauuucaccgacgaaugcgucaagaaguacgaggcauuucugaacaaaucugaagaguggauacguaagaugcuacaccuccggaaacagcugcuuagcuugacaaaucaauguuucgauaucgaggaagaggugucaaaguaucaggaauacaccaacgagcugcaggaaacucucccgcagaaaauguuuacggccaguuccggcauuaagcacacaaugaccccuaucuaccccagcucuaauacucugguugagaugaccuuagggaugaaaaagcugaaggaggaaauggagggaguggucaaagaacuugcugagaacaaucauauuuuggagcgauucgguucacucacaauggacggcgggcugagaaacguggauugccuauga

SEQ ID NO: 9408 - RNA, 2190 nt, Artificial Sequence
  derived and/or modified sequence opt4 from TBK1__Homo_sapiens__AAF05989
augcagagcaccagcaaccaccuguggcugcugagcgacauccugggccagggcgccaccgccaacguguucagaggcagacacaagaagaccggcgaccuguucgccaucaagguguucaacaacaucagcuuccugagacccguggacgugcagaugagagaguucgaggugcugaagaagcugaaccacaagaacaucgugaagcuguucgccaucgaggaggagaccaccaccagacacaaggugcugaucauggaguucugccccugcggcagccuguacaccgugcuggaggagcccagcaacgccuacggccugcccgagagcgaguuccugaucgugcugagagacguggugggcggcaugaaccaccugagagagaacggcaucgugcacagagacaucaagcccggcaacaucaugagagugaucggcgaggacggccagagcguguacaagcugaccgacuucggcgccgccagagagcuggaggacgacgagcaguucgugagccuguacggcaccgaggaguaccugcaccccgacauguacgagagagccgugcugagaaaggaccaccagaagaaguacggcgccaccguggaccuguggagcaucggcgugaccuucuaccacgccgccaccggcagccugcccuucagacccuucgagggccccagaagaaacaaggaggugauguacaagaucaucaccggcaagcccagcggcgccaucagcggcgugcagaaggccgagaacggccccaucgacuggagcggcgacaugcccgugagcugcagccugagcagaggccugcaggugcugcugacccccgugcuggccaacauccuggaggccgaccaggagaagugcuggggcuucgaccaguucuucgccgagaccagcgacauccugcacagaauggugauccacguguucagccugcagcagaugaccgcccacaagaucuacauccacagcuacaacaccgccaccaucuuccacgagcugguguacaagcagaccaagaucaucagcagcaaccaggagcugaucuacgagggcagaagacuggugcuggagcccggcagacuggcccagcacuuccccaagaccaccgaggagaaccccaucuucguggugagcagagagccccugaacaccaucggccugaucuacgagaagaucagccugcccaaggugcaccccagauacgaccuggacggcgacgccagcauggccaaggccaucaccggcguggugugcuacgccugcagaaucgccagcacccugcugcuguaccaggagcugaugagaaagggcaucagauggcugaucgagcugaucaaggacgacuacaacgagaccgugcacaagaagaccgagguggugaucacccuggacuucugcaucagaaacaucgagaagaccgugaagguguacgagaagcugaugaagaucaaccuggaggccgccgagcugggcgagaucagcgacauccacaccaagcugcugagacugagcagcagccagggcaccaucgagaccagccugcaggacaucgacagcagacugagccccggcggcagccuggccgacgccugggcccaccaggagggcacccaccccaaggacagaaacguggagaagcugcaggugcugcugaacugcaugaccgagaucuacuaccaguucaagaaggacaaggccgagagaagacuggccuacaacgaggagcagauccacaaguucgacaagcagaagcuguacuaccacgccaccaaggccaugacccacuucaccgacgagugcgugaagaaguacgaggccuuccugaacaagagcgaggaguggaucagaaagaugcugcaccugagaaagcagcugcugagccugaccaaccagugcuucgacaucgaggaggaggugagcaaguaccaggaguacaccaacgagcugcaggagacccugccccagaagauguucaccgccagcagcggcaucaagcacaccaugacccccaucuaccccagcagcaacacccugguggagaugacccugggcaugaagaagcugaaggaggagauggagggcguggugaaggagcuggccgagaacaaccacauccuggagagauucggcagccugaccauggacggcggccugagaaacguggacugccuguga

SEQ ID NO: 9409 - RNA, 2190 nt, Artificial Sequence
  derived and/or modified sequence opt5 from TBK1__Homo_sapiens__AAF05989
augcagagcaccuccaaccaccuguggcuccugucugacauccuuggccaaggggccacagcuaauguguucagaggacggcauaagaaaacgggcgaucuguuugccauuaaggucuucaacaauaucagcuuucuccgccccguugacgugcagaugagagaguucgaagugcugaaaaagcugaaccacaaaaauauugucaagcuguuugcgaucgaggaagagaccacaacccggcauaaggugcucauuauggaguucugcccuugugggucccuguacacaguucuggaggagccgucuaacgcuuauggacuccccgaaagcgaguuucugaucgugcuucgcgaugucgugggcgggaugaaucaccugagagaaaacggaaucguucaucgggacauuaaaccuggcaauaucaugcgcgugauuggcgaggaugggcaguccgucuacaagcucaccgacuucggagccgccagagagcuggaagaugacgagcaguuugugucucuuuauggcacagaagaguaccugcaccccgauauguaugaacgggcugugcuccgcaaagaccaccaaaagaaauacggggccaccgucgaucuguggagcaucggaguuacguucuaucaugcugccaccggcucccugccuuuuagacccuucgaggggccucggcgcaacaaggaggugauguacaagauuaucacaggaaaaccgagcggcgcgauuucuggcgugcagaaggccgaaaaugggcccaucgacugguccggagauaugccugucagcugcucucucuccagaggccuucaggugcuucugacccccguucucgcuaacauccuggaggccgaccaggaaaaauguuggggguuugaccaauucuucgcugagacaagcgauauucuucaccggauggugauccaugucuuuucucugcagcagaugaccgcccacaagauuuacauccacuccuauaauacggcgacaauuuuccaugaacucguguacaaacagaccaagaucaucagcuccaaccaagagcugauuuaugagggacgcagacugguucucgaaccuggccggcuggcccagcacuuucccaaaacaaccgaggaaaauccgaucuucguggucucuagagagccucuuaacaccauugggcugaucuacgaaaagauuagccuccccaaggugcauccucgcuaugaccuggauggagacgcuuccauggccaaagcuaucacaggcgucgugugcuacgccugucggaucgccagcacgcuucugcucuaucaggagcugaugagaaagggcauucgcuggcugaucgagcucauuaaagaugacuacaacgaaaccguucacaagaaaacagagguggucaucacccuggauuuuugcauucggaauaucgaaaagacagugaagguuuacgagaaacuuaugaagauuaaccuggaggcugcggaacucggggagaucucugacauccauaccaaacugcugagacuuuccagcucucaaggaacgauugaaacaagccuccaggauaucgacucccgccugucucccggcgggagccuggccgaugcuugggcccaccaggagggaacccaccccaaggaccggaauguggaaaaacuccagguccugcuuaacuguaugaccgagauuuauuaccaauucaagaaggacaaagccgagagacgccuggcuuauaaugaagaacagauccauaaguuugauaaacagaagcucuacuaucacgccacaaaagcgaugacccauuucacagacgaaugcgugaagaaguacgaggcuuuucugaacaaauccgaagaguggauucggaagaugcugcaccuuagaaaacagcuccugagccugacgaaucaauguuucgauaucgaggaagaggugucuaaguaucaggaauacaccaacgagcuccaggaaacacugccucagaaaauguuuaccgccuccagcggcaucaagcacacaaugaccccgauuuaccccucuuccaauacgcuuguugagaugacccuggggaugaaaaagcucaaggaggaaauggagggcgucgugaaagaacuggccgagaacaaucauauccuggagcgcuucggaagccuuacaauggacggcgggcuccggaacguggauugccuguga

SEQ ID NO: 9410 - protein, 712 aa, Artificial Sequence
  TICAM1__Homo_sapiens__Q8IUC6
MACTGPSLPSAFDILGAAGQDKLLYLKHKLKTPRPGCQGQDLLHAMVLLKLGQETEARISLEALKADAVARLVARQWAGVDSTEDPEEPPDVSWAVARLYHLLAEEKLCPASLRDVAYQEAVRTLSSRDDHRLGELQDEARNRCGWDIAGDPGSIRTLQSNLGCLPPSSALPSGTRSLPRPIDGVSDWSQGCSLRSTGSPASLASNLEISQSPTMPFLSLHRSPHGPSKLCDDPQASLVPEPVPGGCQEPEEMSWPPSGEIASPPELPSSPPPGLPEVAPDATSTGLPDTPAAPETSTNYPVECTEGSAGPQSLPLPILEPVKNPCSVKDQTPLQLSVEDTTSPNTKPCPPTPTTPETSPPPPPPPPSSTPCSAHLTPSSLFPSSLESSSEQKFYNFVILHARADEHIALRVREKLEALGVPDGATFCEDFQVPGRGELSCLQDAIDHSAFIILLLTSNFDCRLSLHQVNQAMMSNLTRQGSPDCVIPFLPLESSPAQLSSDTASLLSGLVRLDEHSQIFARKVANTFKPHRLQARKAMWRKEQDTRALREQSQHLDGERMQAAALNAAYSAYLQSYLSYQAQMEQLQVAFGSHMSFGTGAPYGARMPFGGQVPLGAPPPFPTWPGCPQPPPLHAWQAGTPPPPSPQPAAFPQSLPFPQSPAFPTASPAPPQSPGLQPLIIHHAQMVQLGLNNHMWNQRGSQAPEDKTQEAE

SEQ ID NO: 9411 - RNA, 2139 nt, Artificial Sequence
  TICAM1__Homo_sapiens__AAI36557
auggccugcacgggcccaucacuuccuagcgccuucgacauucuaggugcagcaggccaggacaagcucuuguaucugaagcacaaacugaagaccccacgcccaggcugccaggggcaggaccuccugcaugccaugguucuccugaagcugggccaggaaacugaggccaggaucucucuagaggcauugaaggccgaugcgguggcccggcugguggcccgccagugggcuggcguggacagcaccgaggacccagaggagcccccagauguguccugggcuguggcccgcuuguaccaccugcuggcugaggagaagcugugccccgccucgcugcgggacguggccuaccaggaagccguccgcacccucagcuccagggacgaccaccggcugggggaacuucaggaugaggcccgaaaccggugugggugggacauugcuggggauccagggagcauccggacgcuccaguccaaucugggcugccucccaccauccucggcuuugcccucugggaccaggagccucccacgccccauugacgguguuucggacuggagccaagggugcucccugcgauccacuggcagcccugccucccuggccagcaacuuggaaaucagccaguccccuaccaugcccuuccucagccugcaccgcagcccacaugggcccagcaagcucugugacgacccccaggccagcuuggugcccgagccuguccccgguggcugccaggagccugaggagaugagcuggccgccaucgggggagauugccagcccaccagagcugccaagcagcccaccuccugggcuucccgaaguggccccagaugcaaccuccacuggccucccugauacccccgcagcuccagaaaccagcaccaacuacccaguggagugcaccgaggggucugcaggcccccagucucuccccuugccuauucuggagccggucaaaaaccccugcucugucaaagaccagacgccacuccaacuuucuguagaagauaccaccucuccaaauaccaagccgugcccaccuacucccaccaccccagaaacauccccuccuccuccuccuccuccuccuucaucuacuccuuguucagcucaccugacccccuccucccuguucccuuccucccuggaaucaucaucggaacagaaauucuauaacuuugugauccuccacgccagggcagacgaacacaucgcccugcggguucgggagaagcuggaggcccuuggcgugcccgacggggccaccuucugcgaggauuuccaggugccggggcgcggggagcugagcugccugcaggacgccauagaccacucagcuuucaucauccuacuucucaccuccaacuucgacugucgccugagccugcaccaggugaaccaagccaugaugagcaaccucacgcgacaggggucgccagacugugucauccccuuccugccccuggagagcuccccggcccagcucagcuccgacacggccagccugcucuccgggcuggugcggcuggacgaacacucccagaucuucgccaggaagguggccaacaccuucaagccccacaggcuucaggcccgaaaggccauguggaggaaggaacaggacacccgagcccugcgggaacagagccaacaccuggauggugagcggaugcaggcggcggcacugaacgcagccuacucagccuaccuccagagcuacuuguccuaccaggcacagauggagcagcuccagguggcuuuugggagccacaugucauuugggacuggggcgcccuauggggcucgaaugcccuuugggggccaggugccccugggagccccgccacccuuucccacuuggccggggugcccgcagccgccaccccugcacgcauggcaggcuggcacccccccaccgcccuccccacagccagcagccuuuccacagucacugcccuucccgcaguccccagccuucccuacggccucacccgcacccccucagagcccagggcugcaaccccucauuauccaccacgcacagaugguacagcuggggcugaacaaccacauguggaaccagagagggucccaggcgcccgaggacaagacgcaggaggcagaauga

SEQ ID NO: 9412 - RNA, 2139 nt, Artificial Sequence
  derived and/or modified sequence opt1 from TICAM1__Homo_sapiens__AAI36557
auggccugcaccggccccagccugccguccgccuucgacauccucggggcggccggccaggacaagcugcuguaccucaagcacaagcugaagacgccccgccccgggugccagggccaggaccugcuccacgccauggugcugcugaagcucgggcaggagaccgaggcccggaucagccuggaggcccugaaggcggacgccgucgcccgccucguggcccggcagugggcgggcguggacuccaccgaggaccccgaggagccgcccgacgucagcugggccguggcccgccuguaccaccuccucgccgaggagaagcugugccccgccucccugcgggacguggcguaccaggaggccguccgcacccucagcucccgggacgaccaccgccugggcgagcugcaggacgaggcccggaaccgcugcgggugggacaucgccggcgaccccgggagcauccggacccuccaguccaaccugggcugccugccgcccagcuccgcccuccccagcgggacgcgcucccugccccggccgaucgacggcgugagcgacuggucccagggcugcagccugcgcuccaccgggagccccgcgucccucgccagcaaccuggagaucagccagucccccaccaugcccuuccugagccuccaccgguccccgcacggccccagcaagcugugcgacgacccccaggccucccuggugcccgagccgguccccgggggcugccaggagcccgaggagaugagcuggcccccguccggcgagaucgccagcccgcccgagcugcccuccagcccgccgcccgggcugcccgagguggcccccgacgcgaccuccacgggccugcccgacacccccgccgcccccgagaccagcaccaacuaccccguggagugcacggagggguccgccggcccccagagccucccccugccgauccuggagcccgucaagaaccccugcuccgugaaggaccagacgccccuccagcugagcguggaggacaccaccuccccgaacaccaagcccugcccgcccacccccaccacccccgagacgagcccgccgcccccgccgccgccgcccuccagcacccccugcagcgcccaccugacccccuccagccucuuccccuccagccuggaguccagcuccgagcagaaguucuacaacuucgucauccugcacgcgcgcgccgacgagcacaucgcccuccgggugcgcgagaagcuggaggcccugggggugcccgacggcgcgaccuucugcgaggacuuccagguccccggccgcggggagcucagcugccugcaggacgccaucgaccacuccgccuucaucauccugcugcucacgagcaacuucgacugccggcugucccugcaccaggugaaccaggccaugaugagcaaccucacccggcagggcucccccgacugcgugauccccuuccugccccuggagagcucccccgcccagcucagcuccgacaccgcgagccugcugagcgggcucguccgccuggacgagcacucccagaucuucgcccgcaagguggccaacaccuucaagccccaccggcugcaggcccgcaaggccauguggcggaaggagcaggacacgcgcgcgcuccgggagcagagccagcaccuggacggcgagcgcaugcaggccgccgcccugaacgccgcguacuccgccuaccuccagagcuaccuguccuaccaggcccagauggagcagcuccagguggccuucgggagccacauguccuucggcaccggcgcgcccuacggggcccggaugcccuucggcgggcaggucccccugggcgcgcccccgcccuuccccaccuggcccgggugcccccagccgccgccccugcacgccuggcaggccggcacgccgcccccgcccagcccccagcccgccgccuucccccagucccugcccuucccccagagccccgccuuccccaccgccucccccgccccgccccagagccccggccuccagccccugaucauccaccacgcgcagauggugcagcuggggcucaacaaccacauguggaaccagcgcggcucccaggcccccgaggacaagacccaggaggccgaguga

SEQ ID NO: 9413 - RNA, 2139 nt, Artificial Sequence
  derived and/or modified sequence opt2 from TICAM1__Homo_sapiens__AAI36557
auggccugcaccggccccucccuccccuccgccuucgacauccucggcgccgccggccaggacaagcuccucuaccucaagcacaagcucaagaccccccgccccggcugccagggccaggaccuccuccacgccaugguccuccucaagcucggccaggagaccgaggcccgcaucucccucgaggcccucaaggccgacgccgucgcccgccucgucgcccgccagugggccggcgucgacuccaccgaggaccccgaggagccccccgacgucuccugggccgucgcccgccucuaccaccuccucgccgaggagaagcucugccccgccucccuccgcgacgucgccuaccaggaggccguccgcacccucuccucccgcgacgaccaccgccucggcgagcuccaggacgaggcccgcaaccgcugcggcugggacaucgccggcgaccccggcuccauccgcacccuccaguccaaccucggcugccucccccccuccuccgcccuccccuccggcacccgcucccucccccgccccaucgacggcgucuccgacuggucccagggcugcucccuccgcuccaccggcucccccgccucccucgccuccaaccucgagaucucccagucccccaccaugcccuuccucucccuccaccgcuccccccacggccccuccaagcucugcgacgacccccaggccucccucguccccgagcccguccccggcggcugccaggagcccgaggagauguccuggccccccuccggcgagaucgccuccccccccgagcuccccuccucccccccccccggccuccccgaggucgcccccgacgccaccuccaccggccuccccgacacccccgccgcccccgagaccuccaccaacuaccccgucgagugcaccgagggcuccgccggcccccagucccucccccuccccauccucgagcccgucaagaaccccugcuccgucaaggaccagaccccccuccagcucuccgucgaggacaccaccucccccaacaccaagcccugcccccccacccccaccacccccgagaccuccccccccccccccccccccccccccuccuccacccccugcuccgcccaccucacccccuccucccucuuccccuccucccucgaguccuccuccgagcagaaguucuacaacuucgucauccuccacgcccgcgccgacgagcacaucgcccuccgcguccgcgagaagcucgaggcccucggcguccccgacggcgccaccuucugcgaggacuuccagguccccggccgcggcgagcucuccugccuccaggacgccaucgaccacuccgccuucaucauccuccuccucaccuccaacuucgacugccgccucucccuccaccaggucaaccaggccaugauguccaaccucacccgccagggcucccccgacugcgucauccccuuccucccccucgaguccucccccgcccagcucuccuccgacaccgccucccuccucuccggccucguccgccucgacgagcacucccagaucuucgcccgcaaggucgccaacaccuucaagccccaccgccuccaggcccgcaaggccauguggcgcaaggagcaggacacccgcgcccuccgcgagcagucccagcaccucgacggcgagcgcaugcaggccgccgcccucaacgccgccuacuccgccuaccuccaguccuaccucuccuaccaggcccagauggagcagcuccaggucgccuucggcucccacauguccuucggcaccggcgcccccuacggcgcccgcaugcccuucggcggccaggucccccucggcgcccccccccccuuccccaccuggcccggcugcccccagccccccccccuccacgccuggcaggccggcaccccccccccccccuccccccagcccgccgccuucccccagucccuccccuucccccagucccccgccuuccccaccgccucccccgcccccccccagucccccggccuccagccccucaucauccaccacgcccagaugguccagcucggccucaacaaccacauguggaaccagcgcggcucccaggcccccgaggacaagacccaggaggccgaguga

SEQ ID NO: 9414 - RNA, 2139 nt, Artificial Sequence
  derived and/or modified sequence opt3 from TICAM1__Homo_sapiens__AAI36557
auggccugcaccggccccagccugccuuccgcuuucgacauccucggggcagccggacaggauaagcugcuguacuugaaacacaaguuaaaaacaccaagaccggguugucaaggccaggaccugcuacaugcgauggugcuccugaaacuugggcaggagacugaagcuaggauuucucuggaggccuugaaggcagaugccgucgcucggcucguugcacgccagugggccggaguggacucaacggaagaucccgaggaaccuccagacguaaguugggcuguggcccgacuguaucaccuucucgcggaggagaaguuaugccccgcaagccugcgugaugucgccuaccaagaagcugugagaacccuuuccucuagggacgaucaucgguugggcgagcugcaggacgaagcccgcaacagaugugguugggauauagcaggggacccuggaucgaucaggacacuacagucaaaucucggcugccugccacccagcagugcccuuccuuccggcacucggucucugccacgcccgauugaugggguuagcgacuggucccagggauguucauugcgaaguaccgguagccccgcuucucucgcguccaaccuggagaucucacaaagcccuacaaugccauuuuuaagucugcacagaucuccccauggcccuuccaagcucugcgacgauccacaggccagccuugugcccgagccggucccugggggaugucaggaacccgaggaaaugucguggccaccuucuggcgagauugcauccccuccagaacugcccucaaguccuccaccggguuugcccgagguggcuccugacgccaccagcacugggcuaccagauacacccgcugccccugagaccuccacgaauuauccaguagaaugcacugagggaucugcaggcccccagagccugccgcucccuauccuggaaccaguuaaaaaccccuguucagugaaggaccaaaccccucuucagcugagugucgaggauacaacuucccccaauaccaaaccaugcccucccacaccaaccacgccggaaacuagcccucccccacccccuccacccccuucuucaacaccguguagugcccacuugaccccaagcucccucuuccccucuucgcuggagagcuccucagagcagaaguuuuacaacuucgugauauuacacgcuagggcggacgaacauaucgcacugcgggugcgugagaaacuagaagcccucggcgucccugauggggcuacuuuuugcgaggacuuccaaguuccaggacgcggugaacugaguugccuucaggaugccauugaccacucugcauuuaucauuuugcugcucacaagcaauuucgauuguagacugucccuucaucaggugaaccaggccaugaugucaaaucugaccaggcaaggcagccccgacugcguaauccccuuuuugccgcucgagucuucccccgcucagcugaguagcgacacggccucuuuacuguccgggcuagugcggcucgaugagcacucacagauauucgcacgaaaggucgcgaacaccuuuaagccacaccgccugcaggcuagaaaagccauguggaggaaggaacaagacacacgggcacuucgcgagcagagucagcauuuggauggagaaagaaugcaggccgcugcccugaaugcagcuuauagcgccuaccuccaaucguaucuguccuaccaggcgcagauggagcaguuacaaguggccuucggcucucacaugagcuuugguacuggggcuccuuacggcgcaaggaugcccuucggaggccagguuccacugggggccccucccccauucccgaccuggccuggauguccccagccacccccucuucaugcuuggcaagccgguacaccacccccuccgucaccacagcccgcagcguuuccucagaguuugcccuucccacaguccccugccuuucccacugcuucuccagccccuccgcaaagccccggccuccagccacugauuauccaccaugcacagauggugcagcuagggcugaacaaucacauguggaaccaacguggaucccaggcuccugaggacaaaacccaggaagccgaguga

SEQ ID NO: 9415 - RNA, 2139 nt, Artificial Sequence
  derived and/or modified sequence opt4 from TICAM1__Homo_sapiens__AAI36557
auggccugcaccggccccagccugcccagcgccuucgacauccugggcgccgccggccaggacaagcugcuguaccugaagcacaagcugaagacccccagacccggcugccagggccaggaccugcugcacgccauggugcugcugaagcugggccaggagaccgaggccagaaucagccuggaggcccugaaggccgacgccguggccagacugguggccagacagugggccggcguggacagcaccgaggaccccgaggagccccccgacgugagcugggccguggccagacuguaccaccugcuggccgaggagaagcugugccccgccagccugagagacguggccuaccaggaggccgugagaacccugagcagcagagacgaccacagacugggcgagcugcaggacgaggccagaaacagaugcggcugggacaucgccggcgaccccggcagcaucagaacccugcagagcaaccugggcugccugccccccagcagcgcccugcccagcggcaccagaagccugcccagacccaucgacggcgugagcgacuggagccagggcugcagccugagaagcaccggcagccccgccagccuggccagcaaccuggagaucagccagagccccaccaugcccuuccugagccugcacagaagcccccacggccccagcaagcugugcgacgacccccaggccagccuggugcccgagcccgugcccggcggcugccaggagcccgaggagaugagcuggccccccagcggcgagaucgccagcccccccgagcugcccagcagccccccccccggccugcccgagguggcccccgacgccaccagcaccggccugcccgacacccccgccgcccccgagaccagcaccaacuaccccguggagugcaccgagggcagcgccggcccccagagccugccccugcccauccuggagcccgugaagaaccccugcagcgugaaggaccagaccccccugcagcugagcguggaggacaccaccagccccaacaccaagcccugcccccccacccccaccacccccgagaccagcccccccccccccccccccccccccagcagcacccccugcagcgcccaccugacccccagcagccuguuccccagcagccuggagagcagcagcgagcagaaguucuacaacuucgugauccugcacgccagagccgacgagcacaucgcccugagagugagagagaagcuggaggcccugggcgugcccgacggcgccaccuucugcgaggacuuccaggugcccggcagaggcgagcugagcugccugcaggacgccaucgaccacagcgccuucaucauccugcugcugaccagcaacuucgacugcagacugagccugcaccaggugaaccaggccaugaugagcaaccugaccagacagggcagccccgacugcgugauccccuuccugccccuggagagcagccccgcccagcugagcagcgacaccgccagccugcugagcggccuggugagacuggacgagcacagccagaucuucgccagaaagguggccaacaccuucaagccccacagacugcaggccagaaaggccauguggagaaaggagcaggacaccagagcccugagagagcagagccagcaccuggacggcgagagaaugcaggccgccgcccugaacgccgccuacagcgccuaccugcagagcuaccugagcuaccaggcccagauggagcagcugcagguggccuucggcagccacaugagcuucggcaccggcgcccccuacggcgccagaaugcccuucggcggccaggugccccugggcgcccccccccccuuccccaccuggcccggcugcccccagccccccccccugcacgccuggcaggccggcaccccccccccccccagcccccagcccgccgccuucccccagagccugcccuucccccagagccccgccuuccccaccgccagccccgcccccccccagagccccggccugcagccccugaucauccaccacgcccagauggugcagcugggccugaacaaccacauguggaaccagagaggcagccaggcccccgaggacaagacccaggaggccgaguga

SEQ ID NO: 9416 - RNA, 2139 nt, Artificial Sequence
  derived and/or modified sequence opt5 from TICAM1__Homo_sapiens__AAI36557
auggccugcaccggccccagccugccuuccgcuuucgacauccucggggccgcgggacaggauaagcugcuuuaccugaaacacaagcucaaaacaccgagacccggcugucaagggcaggaccugcuucaugcuauggugcugcucaagcugggacaggagacggaagcccggauuucucuggaggcccucaaagcugaugccgucgcucgccugguugccagacagugggcgggcguggacagcaccgaagauccugaggaacccccugacguguccugggccgucgcucggcuuuaucaucugcucgccgaggagaagcugugccccgcuucucuucgcgauguggccuaccaagaagcgguuagaacacugagcucccgggacgaucaccgccucggggagcugcaggacgaagccagaaaccgguguggaugggauaucgcuggcgacccuggcucuauucgcacccugcagagcaaucucgggugccugccgcccuccagcgcccuuccuucuggaacaagaucccugccccggccuaucgauggcgugagcgacuggucucagggguguucccuccgcagcaccggaucucccgcuucccuggccagcaaccuugagauuucccaaucuccgacaaugccuuuucugagccuccacagauccccgcauggcccuagcaagcugugcgacgauccccaggccucucugguccccgagccugugcccgggggaugucaggaacccgaggaaauguccuggccucccagcggcgagaucgcuucuccucccgaacucccgagcuccccucccccuggccugcccgagguugcgccugacgccaccucuacggggcuucccgauaccccggcugccccugagacaagcaccaauuaucccguggaaugcacagagggauccgccggcccccagagccugccucucccgauccuggaacccgucaaaaacccuuguucugugaaggaccaaacgccccuucagcuguccguggaggauaccacaagcccuaauaccaaacccugcccucccacaccgaccaccccugaaacaucucccccucccccgccucccccucccuccagcacgcccuguuccgcucaccucaccccuucuagccuguucccguccucucuggagagcuccagcgagcagaaguuuuacaacuucgucauucuccacgcccgggcggacgaacauaucgcucugcgcguuagagagaaacuugaagcccugggggugcccgauggagccacauuuugcgaggacuuccaagugccuggcagaggggaacucucuugccugcaggaugcuauugaccacuccgccuuuaucauucugcuucucaccagcaauuucgauugucggcugucucugcaucaggucaaccaggcuaugauguccaaucucacacgccaaggaagccccgacugcgugaucccuuuucugccccuugagucuagcccugcccagcuguccagcgacaccgcgucucuccuguccggccugguucggcuugaugagcacagccagauuuucgccagaaagguggcuaacacguuuaagccgcaccgccuccaggcccggaaagcuauguggagaaaggaacaagacacacgcgcccugcgggagcagucccagcaucuggauggcgaaagaaugcaggcggccgcucucaaugccgcuuauucugccuaccugcaaagcuaucuuuccuaccaggcccagauggagcagcugcaagucgcuuucgggucucacaugagcuuuggaaccggcgcgcccuacggggcccgcaugccuuucggaggccaggugccccucggggcuccucccccguucccuaccuggcccggcuguccccagccucccccucugcaugccuggcaagccggaacaccgcccccucccuccccucagcccgcugccuuuccgcagucucugccuuucccccagagcccugcguuucccaccgcuuccccugcucccccgcaaagcccuggccuucagccccucaucauccaccaugcccagaugguucagcuggggcugaacaaucacauguggaaccaacggggaucucaggcccccgaggacaaaacacaggaagccgaguga

SEQ ID NO: 9417 - protein, 235 aa, Artificial Sequence
  TICAM2__Homo_sapiens__Q86XR7
MGIGKSKINSCPLSLSWGKRHSVDTSPGYHESDSKKSEDLSLCNVAEHSNTTEGPTGKQEGAQSVEEMFEEEAEEEVFLKFVILHAEDDTDEALRVQNLLQDDFGIKPGIIFAEMPCGRQHLQNLDDAVNGSAWTILLLTENFLRDTWCNFQFYTSLMNSVNRQHKYNSVIPMRPLNNPLPRERTPFALQTINALEEESRGFPTQVERIFQESVYKTQQTIWKETRNMVQRQFIA

SEQ ID NO: 9418 - RNA, 708 nt, Artificial Sequence
  TICAM2__Homo_sapiens__AAI09266
auggguaucgggaagucuaaaauaaauuccugcccucuuucucucucuugggguaaaaggcacaguguggauacaaguccaggauaucaugagucagauuccaagaagucugaagaucuauccuuguguaauguugcugagcacagcaauacaacagaggggccaacaggaaagcaggagggagcucagagcguggaagagauguuugaagaagaagcugaagaagagguguuccucaaauuugugauauugcaugcagaagaugacacagaugaagcccucagaguccagaaucugcuacaagaugacuuugguaucaaacccggaauaaucuuugcugagaugccauguggcagacagcauuuacagaauuuagaugaugcuguaaaugggucugcauggacaaucuuauuacugacugaaaacuuuuuaagagauacuugguguaauuuccaguucuauacgucccuaaugaacuccguuaacaggcagcauaaauacaacucuguuauacccaugcggccccugaacaauccccuuccccgagaaaggacucccuuugcccuccaaaccaucaaugccuuagaggaagaaagucguggauuuccuacacaaguagaaagaauuuuucaggagucuguguauaagacacaacaaacuauauggaaagagacaagaaauaugguacaaagacaauuuauugccuga

SEQ ID NO: 9419 - RNA, 708 nt, Artificial Sequence
  derived and/or modified sequence opt1 from TICAM2__Homo_sapiens__AAI09266
augggcaucggcaagagcaagaucaacuccugcccccugagccucuccugggggaagcgccacagcguggacaccuccccgggguaccacgagagcgacuccaagaaguccgaggaccugagccugugcaacgucgccgagcacagcaacaccacggagggccccaccgggaagcaggagggcgcccaguccguggaggagauguucgaggaggaggcggaggaggagguguuccucaaguucgucauccugcacgccgaggacgacaccgacgaggcccugcgggugcagaaccuccugcaggacgacuucggcaucaagcccgggaucaucuucgccgagaugcccugcggccgccagcaccuccagaaccuggacgacgccgugaacgggagcgcguggaccauccugcugcucacggagaacuuccugcgggacaccuggugcaacuuccaguucuacaccucccugaugaacagcgucaaccgccagcacaaguacaacuccgugaucccgaugcggccccucaacaacccccugccccgcgagcggaccccguucgcccugcagacgaucaacgcccucgaggaggagagccgcggcuuccccacccagguggagcggaucuuccaggaguccgucuacaagacccagcagaccaucuggaaggagacgcgcaacauggugcagcggcaguucaucgccuga

SEQ ID NO: 9420 - RNA, 708 nt, Artificial Sequence
  derived and/or modified sequence opt2 from TICAM2__Homo_sapiens__AAI09266
augggcaucggcaaguccaagaucaacuccugcccccucucccucuccuggggcaagcgccacuccgucgacaccucccccggcuaccacgaguccgacuccaagaaguccgaggaccucucccucugcaacgucgccgagcacuccaacaccaccgagggccccaccggcaagcaggagggcgcccaguccgucgaggagauguucgaggaggaggccgaggaggaggucuuccucaaguucgucauccuccacgccgaggacgacaccgacgaggcccuccgcguccagaaccuccuccaggacgacuucggcaucaagcccggcaucaucuucgccgagaugcccugcggccgccagcaccuccagaaccucgacgacgccgucaacggcuccgccuggaccauccuccuccucaccgagaacuuccuccgcgacaccuggugcaacuuccaguucuacaccucccucaugaacuccgucaaccgccagcacaaguacaacuccgucauccccaugcgcccccucaacaacccccucccccgcgagcgcacccccuucgcccuccagaccaucaacgcccucgaggaggagucccgcggcuuccccacccaggucgagcgcaucuuccaggaguccgucuacaagacccagcagaccaucuggaaggagacccgcaacaugguccagcgccaguucaucgccuga

SEQ ID NO: 9421 - RNA, 708 nt, Artificial Sequence
  derived and/or modified sequence opt3 from TICAM2__Homo_sapiens__AAI09266
augggcaucggaaagagcaaaauuaacuccugcccccugucucucucaugggggaagagacacaguguggacaccagcccugguuaccaugaguccgauucuaaaaagucggaagaccuuucacuguguaaugucgccgagcacagcaacacaacugaaggcccaacggggaaacaggagggagcucaaaguguugaagagauguucgaggaagaggcagaagaggagguguuuuugaaguucguaauauuacaugccgaagaugacaccgaugaggcgcugagggugcagaaucuacuccaggacgauuuuggcaucaagccggguauuaucuucgcugaaaugcccugcgggcggcagcaucugcaaaaccuugacgaugccgucaauggauccgcauggacaauucuguugcucacugagaacuuucugcgcgacaccugguguaauuuccaguuuuauacaucucugaugaacagcgugaaucgacagcacaaauacaacuccguuaucccuaugcguccacucaauaaccccuuaccuagagaaaggaccccauucgcccugcagacuauaaaugcucuugaggaggaaucacggggcuuucccacacaaguggagcgcaucuuccaggaaagugucuauaagacccagcagacgauuuggaaagagacuagaaacauggugcaaaggcaguuuaucgcauga

SEQ ID NO: 9422 - RNA, 708 nt, Artificial Sequence
  derived and/or modified sequence opt4 from TICAM2__Homo_sapiens__AAI09266
augggcaucggcaagagcaagaucaacagcugcccccugagccugagcuggggcaagagacacagcguggacaccagccccggcuaccacgagagcgacagcaagaagagcgaggaccugagccugugcaacguggccgagcacagcaacaccaccgagggccccaccggcaagcaggagggcgcccagagcguggaggagauguucgaggaggaggccgaggaggagguguuccugaaguucgugauccugcacgccgaggacgacaccgacgaggcccugagagugcagaaccugcugcaggacgacuucggcaucaagcccggcaucaucuucgccgagaugcccugcggcagacagcaccugcagaaccuggacgacgccgugaacggcagcgccuggaccauccugcugcugaccgagaacuuccugagagacaccuggugcaacuuccaguucuacaccagccugaugaacagcgugaacagacagcacaaguacaacagcgugauccccaugagaccccugaacaacccccugcccagagagagaacccccuucgcccugcagaccaucaacgcccuggaggaggagagcagaggcuuccccacccagguggagagaaucuuccaggagagcguguacaagacccagcagaccaucuggaaggagaccagaaacauggugcagagacaguucaucgccuga

SEQ ID NO: 9423 - RNA, 708 nt, Artificial Sequence
  derived and/or modified sequence opt5 from TICAM2__Homo_sapiens__AAI09266
augggcaucggaaagagcaaaauuaacuccugcccccugucucucagcugggggaagagacacuccguggacaccucuccuggcuaccaugagagcgauuccaaaaagucugaagaccugagccuuuguaaugucgccgagcacuccaacacaacggaagggccgaccggaaaacaggagggcgcucaaagcguugaagagauguucgaggaagaggccgaagaggagguguuucugaaguucgugauccuccaugcggaagaugacacagaugaggcucugcggguccagaaucuucugcaggacgauuuugggauuaagcccggaaucauuuucgccgaaaugccuugcggccgccagcaccuccaaaaccuggacgaugccgugaauggcucugcuuggaccauccugcuccugacagagaacuuucuuagagacaccugguguaauuuccaguuuuauacaucccugaugaacagcguuaaucggcagcauaaauacaacucugugauccccaugcgcccucucaauaacccccugccuagagaacggaccccguucgcccuucagacgauuaaugcucuggaggaggaaucccgcggguuucccacccaagucgagagaaucuuccaggaaagcguguauaagacacagcagaccauuuggaaagagacacggaacaugguucaacgccaguuuaucgccuga

SEQ ID NO: 9424 - protein, 221 aa, Artificial Sequence
  TIRAP__Homo_sapiens__A0A024R3M4
MASSTSLPAPGSRPKKPLGKMADWFRQTLLKKPKKRPNSPESTSSDASQPTSQDSPLPPSLSSVTSPSLPPTHASDSGSSRWSKDYDVCVCHSEEDLVAAQDLVSYLEGSTASLRCFLQLRDATPGGAIVSELCQALSSSHCRVLLITPGFLQDPWCKYQMLQALTEAPGAEGCTIPLLSGLSRAAYPPELRFMYYVDGRGPDGGFRQVKEAVMRYLQTLS

SEQ ID NO: 9425 - RNA, 666 nt, Artificial Sequence
  TIRAP__Homo_sapiens__EAW67688
auggcaucaucgaccucccucccagcuccuggcucucggccuaagaagccucuaggcaagauggcugacugguucaggcagacccugcugaagaagcccaagaagaggcccaacuccccagaaagcaccuccagcgaugcuucacagccuaccucacaggacagcccacuacccccaagccucagcucagucacgucucccagccugccacccacacaugcgagugacaguggcaguagucgcuggagcaaagacuaugacgucugcgugugccacagugaggaagaccugguggccgcccaggaccuggucuccuacuuggaaggcagcacugccagccugcgcugcuuccugcaacuccgggaugcaaccccaggcggcgcuauaguguccgagcugugccaggcacugagcaguagucacugccgggugcugcucaucacgccgggcuuccuucaggaccccuggugcaaguaccagaugcugcaggcccugaccgaggcuccaggggccgagggcugcaccaucccccugcugucgggccucagcagagcugccuacccaccugagcuccgauucauguacuacgucgauggcaggggcccugaugguggcuuucgucaagucaaagaagcugucaugcguuaucugcagacacucaguuga

SEQ ID NO: 9426 - RNA, 666 nt, Artificial Sequence
  derived and/or modified sequence opt1 from TIRAP__Homo_sapiens__EAW67688
auggccagcuccaccagccugcccgccccgggcucccgccccaagaagccccucgggaagauggcggacugguuccggcagacccugcugaagaagcccaagaagcgcccgaacagccccgaguccacgagcuccgacgccagccagcccaccucccaggacagcccccucccgcccucccugagcuccgugaccagccccucccugcccccgacccacgccagcgacuccggcagcucccgguggagcaaggacuacgacgucugcgugugccacagcgaggaggaccucguggccgcccaggaccuggucuccuaccuggaggggagcacggcgucccuccgcugcuuccugcagcugcgggacgccacccccggcggggccaucgugagcgagcucugccaggcccuguccagcucccacugccgcgugcugcucaucacccccggcuuccugcaggaccccuggugcaaguaccagaugcugcaggcgcucaccgaggccccgggcgccgaggggugcacgaucccccugcugagcggccucucccgggccgccuacccgcccgagcugcgcuucauguacuacgucgacgggcggggccccgacgggggcuuccgccaggugaaggaggcggugaugcgguaccugcagacccucagcuga

SEQ ID NO: 9427 - RNA, 666 nt, Artificial Sequence
  derived and/or modified sequence opt2 from TIRAP__Homo_sapiens__EAW67688
auggccuccuccaccucccuccccgcccccggcucccgccccaagaagccccucggcaagauggccgacugguuccgccagacccuccucaagaagcccaagaagcgccccaacucccccgaguccaccuccuccgacgccucccagcccaccucccaggacuccccccucccccccucccucuccuccgucaccucccccucccucccccccacccacgccuccgacuccggcuccucccgcugguccaaggacuacgacgucugcgucugccacuccgaggaggaccucgucgccgcccaggaccucgucuccuaccucgagggcuccaccgccucccuccgcugcuuccuccagcuccgcgacgccacccccggcggcgccaucgucuccgagcucugccaggcccucuccuccucccacugccgcguccuccucaucacccccggcuuccuccaggaccccuggugcaaguaccagaugcuccaggcccucaccgaggcccccggcgccgagggcugcaccaucccccuccucuccggccucucccgcgccgccuacccccccgagcuccgcuucauguacuacgucgacggccgcggccccgacggcggcuuccgccaggucaaggaggccgucaugcgcuaccuccagacccucuccuga

SEQ ID NO: 9428 - RNA, 666 nt, Artificial Sequence
  derived and/or modified sequence opt3 from TIRAP__Homo_sapiens__EAW67688
auggccagcuccaccucucugcccgcuccuggcucaagaccaaagaaaccgcucgggaagauggcagacugguucaggcagacacuucugaaaaagcccaaaaagcggccuaacaguccagagagcacuuccucugaugccucgcaacccacgucacaggacagcccuuugccacccaguuuauccucugugaccagcccuucccugccaccgacacacgcgucagauaguggaagcucucgcugguccaaggacuacgaugucugcguuugucauucagaagaggaccuaguggcugcccaggaucucguaagcuaucuggaagguaguacugcaucucuucgaugcuuucugcaguugcgugacgccacccccggcggggcuaucguguccgagcucugucaagcacugagcucgucucacugcagaguccugcucauuacaccuggauucuuacaggauccaugguguaaauaccagaugcugcaggcccuuaccgaagcucccggcgccgaggguugcacuauaccuuugcuguccgggcuaucaagggcggcauauccacccgagcuccgguuuauguacuauguggacggacgcggcccggauggcggguucagacaaguuaaggaagccgugaugagguaccugcagacacuuaguuga

SEQ ID NO: 9429 - RNA, 666 nt, Artificial Sequence
  derived and/or modified sequence opt4 from TIRAP__Homo_sapiens__EAW67688
auggccagcagcaccagccugcccgcccccggcagcagacccaagaagccccugggcaagauggccgacugguucagacagacccugcugaagaagcccaagaagagacccaacagccccgagagcaccagcagcgacgccagccagcccaccagccaggacagcccccugccccccagccugagcagcgugaccagccccagccugccccccacccacgccagcgacagcggcagcagcagauggagcaaggacuacgacgugugcgugugccacagcgaggaggaccugguggccgcccaggaccuggugagcuaccuggagggcagcaccgccagccugagaugcuuccugcagcugagagacgccacccccggcggcgccaucgugagcgagcugugccaggcccugagcagcagccacugcagagugcugcugaucacccccggcuuccugcaggaccccuggugcaaguaccagaugcugcaggcccugaccgaggcccccggcgccgagggcugcaccaucccccugcugagcggccugagcagagccgccuacccccccgagcugagauucauguacuacguggacggcagaggccccgacggcggcuucagacaggugaaggaggccgugaugagauaccugcagacccugagcuga

SEQ ID NO: 9430 - RNA, 666 nt, Artificial Sequence
  derived and/or modified sequence opt5 from TIRAP__Homo_sapiens__EAW67688
auggccagcuccaccucucugcccgcuccuggcagcagaccgaagaaaccccucgggaagauggccgacugguuccggcagacacugcuuaaaaagccuaaaaagcgccccaacuccccugagucuacgagcuccgaugcgucucaacccaccagccaggacuccccucugccgcccagccucucuuccgugacaagcccuucucugcccccuacccacgcuuccgauagcggaucuuccagauggagcaaggacuacgaugucugcguuugucauuccgaagaggaccuuguggccgcccaggaucuggugucuuaucucgaaggcagcacagcuucccugcggugcuuucugcagcuccgcgacgccacccccgggggagcuaucgucagcgagcugugucaagcccuuucuuccagccacugcagagugcugcucauuacaccgggcuuccugcaggauccuugguguaaauaccagaugcuucaggcgcugaccgaagcccccggggcugagggaugcacgaucccucuccugucuggccugagccgggccgcuuauccucccgagcuccgcuuuauguacuauguugacggcagagggcccgauggaggcuuccggcaagugaaggaagccgucaugcgcuaccugcagacccuuuccuga

SEQ ID NO: 9431 - protein, 221 aa, Artificial Sequence; identical to SEQ ID NO: 9424
  TIRAP__Homo_sapiens__P58753

SEQ ID NO: 9432 - RNA, 666 nt, Artificial Sequence
  TIRAP__Homo_sapiens__AAL05036
auggcaucaucgaccucccucccagcuccuggcucucggccuaagaagccucuaggcaagauggcugacugguucaggcagacccugcugaagaagcccaagaagaggcccaacuccccagaaagcaccuccagcgaugcuucacagccuaccucacaggacagcccacuacccccaagccucagcucagucacgucucccagccugccacccacacaugcgagugacaguggcaguagucgcuggagcaaagacuaugacgucugcgugugccacagugaggaagaccugguggccgcccaggaccuggucuccuacuuggaaggcagcacugccagccugcgcugcuuccugcaacuccgggaugcaaccccaggcggcgcuauaguguccgagcugugccaggcacugagcaguagucacugccgggugcugcucaucacgccgggcuuccuucaggaccccuggugcaaguaccagaugcugcaggcccugaccgaggcuccaggggccgagggcugcaccaucccccugcugucgggccucagcagagcugcuuacccaccugagcuccgauucauguacuacgucgauggcaggggcccugaugguggcuuucgucaagucaaagaagcugucaugcguuaucugcagacacucaguuga

SEQ ID NO: 9433 - RNA, 666 nt, Artificial Sequence; identical to SEQ ID NO: 9426
  derived and/or modified sequence opt1 from TIRAP__Homo_sapiens__AAL05036

SEQ ID NO: 9434 - RNA, 666 nt, Artificial Sequence; identical to SEQ ID NO: 9427
  derived and/or modified sequence opt2 from TIRAP__Homo_sapiens__AAL05036

SEQ ID NO: 9435 - RNA, 666 nt, Artificial Sequence; identical to SEQ ID NO: 9428
  derived and/or modified sequence opt3 from TIRAP__Homo_sapiens__AAL05036

SEQ ID NO: 9436 - RNA, 666 nt, Artificial Sequence; identical to SEQ ID NO: 9429
  derived and/or modified sequence opt4 from TIRAP__Homo_sapiens__AAL05036

SEQ ID NO: 9437 - RNA, 666 nt, Artificial Sequence; identical to SEQ ID NO: 9430
  derived and/or modified sequence opt5 from TIRAP__Homo_sapiens__AAL05036

SEQ ID NO: 9438 - protein, 811 aa, Artificial Sequence
  TLR10__Homo_sapiens__A0A024R9W4
MRLIRNIYIFCSIVMTAEGDAPELPEERELMTNCSNMSLRKVPADLTPATTTLDLSYNLLFQLQSSDFHSVSKLRVLILCHNRIQQLDLKTFEFNKELRYLDLSNNRLKSVTWYLLAGLRYLDLSFNDFDTMPICEEAGNMSHLEILGLSGAKIQKSDFQKIAHLHLNTVFLGFRTLPHYEEGSLPILNTTKLHIVLPMDTNFWVLLRDGIKTSKILEMTNIDGKSQFVSYEMQRNLSLENAKTSVLLLNKVDLLWDDLFLILQFVWHTSVEHFQIRNVTFGGKAYLDHNSFDYSNTVMRTIKLEHVHFRVFYIQQDKIYLLLTKMDIENLTISNAQMPHMLFPNYPTKFQYLNFANNILTDELFKRTIQLPHLKTLILNGNKLETLSLVSCFANNTPLEHLDLSQNLLQHKNDENCSWPETVVNMNLSYNKLSDSVFRCLPKSIQILDLNNNQIQTVPKETIHLMALRELNIAFNFLTDLPGCSHFSRLSVLNIEMNFILSPSLDFVQSCQEVKTLNAGRNPFRCTCELKNFIQLETYSEVMMVGWSDSYTCEYPLNLRGTRLKDVHLHELSCNTALLIVTIVVIMLVLGLAVAFCCLHFDLPWYLRMLGQCTQTWHRVRKTTQEQLKRNVRFHAFISYSEHDSLWVKNELIPNLEKEDGSILICLYESYFDPGKSISENIVSFIEKSYKSIFVLSPNFVQNEWCHYEFYFAHHNLFHENSDHIILILLEPIPFYCIPTRYHKLKALLEKKAYLEWPKDRRKCGLFWANLRAAINVNVLATREMYELQTFTELNEESRGSTISLMRTDCL

SEQ ID NO: 9439 - RNA, 2436 nt, Artificial Sequence
  TLR10__Homo_sapiens__EAW92898
augagacucaucagaaacauuuacauauuuuguaguauuguuaugacagcagagggugaugcuccagagcugccagaagaaagggaacugaugaccaacugcuccaacaugucucuaagaaagguucccgcagacuugaccccagccacaacgacacuggauuuauccuauaaccuccuuuuucaacuccagaguucagauuuucauucugucuccaaacugagaguuuugauucuaugccauaacagaauucaacagcuggaucucaaaaccuuugaauucaacaaggaguuaagauauuuagauuugucuaauaacagacugaagaguguaacuugguauuuacuggcaggucucagguauuuagaucuuucuuuuaaugacuuugacaccaugccuaucugugaggaagcuggcaacaugucacaccuggaaauccuagguuugaguggggcaaaaauacaaaaaucagauuuccagaaaauugcucaucugcaucuaaauacugucuucuuaggauucagaacucuuccucauuaugaagaagguagccugcccaucuuaaacacaacaaaacugcacauuguuuuaccaauggacacaaauuucuggguucuuuugcgugauggaaucaagacuucaaaaauauuagaaaugacaaauauagauggcaaaagccaauuuguaaguuaugaaaugcaacgaaaucuuaguuuagaaaaugcuaagacaucgguucuauugcuuaauaaaguugauuuacucugggacgaccuuuuccuuaucuuacaauuuguuuggcauacaucaguggaacacuuucagauccgaaaugugacuuuuggugguaaggcuuaucuugaccacaauucauuugacuacucaaauacuguaaugagaacuauaaaauuggagcauguacauuucagaguguuuuacauucaacaggauaaaaucuauuugcuuuugaccaaaauggacauagaaaaccugacaauaucaaaugcacaaaugccacacaugcuuuucccgaauuauccuacgaaauuccaauauuuaaauuuugccaauaauaucuuaacagacgaguuguuuaaaagaacuauccaacugccucacuugaaaacucucauuuugaauggcaauaaacuggagacacuuucuuuaguaaguugcuuugcuaacaacacacccuuggaacacuuggaucugagucaaaaucuauuacaacauaaaaaugaugaaaauugcucauggccagaaacuguggucaauaugaaucugucauacaauaaauugucugauucugucuucaggugcuugcccaaaaguauucaaauacuugaccuaaauaauaaccaaauccaaacuguaccuaaagagacuauucaucugauggccuuacgagaacuaaauauugcauuuaauuuucuaacugaucucccuggaugcagucauuucaguagacuuucaguucugaacauugaaaugaacuucauucucagcccaucucuggauuuuguucagagcugccaggaaguuaaaacucuaaaugcgggaagaaauccauuccgguguaccugugaauuaaaaaauuucauucagcuugaaacauauucagaggucaugaugguuggauggucagauucauacaccugugaauacccuuuaaaccuaaggggaacuagguuaaaagacguucaucuccacgaauuaucuugcaacacagcucuguugauugucaccauugugguuauuaugcuaguucugggguuggcuguggccuucugcugucuccacuuugaucugcccugguaucucaggaugcuaggucaaugcacacaaacauggcacaggguuaggaaaacaacccaagaacaacucaagagaaauguccgauuccacgcauuuauuucauacagugaacaugauucucugugggugaagaaugaauugauccccaaucuagagaaggaagaugguucuaucuugauuugccuuuaugaaagcuacuuugacccuggcaaaagcauuagugaaaauauuguaagcuucauugagaaaagcuauaaguccaucuuuguuuugucucccaacuuuguccagaaugaguggugccauuaugaauucuacuuugcccaccacaaucucuuccaugaaaauucugaucauauaauucuuaucuuacuggaacccauuccauucuauugcauucccaccagguaucauaaacugaaagcucuccuggaaaaaaaagcauacuuggaauggcccaaggauaggcguaaaugugggcuuuucugggcaaaccuucgagcugcuauuaauguuaauguauuagccaccagagaaauguaugaacugcagacauucacagaguuaaaugaagagucucgagguucuacaaucucucugaugagaacagauugucuauaa

SEQ ID NO: 9440 - RNA, 2436 nt, Artificial Sequence
  derived and/or modified sequence opt1 from TLR10__Homo_sapiens__EAW92898
augcgccugauccggaacaucuacaucuucugcagcaucgugaugaccgccgagggcgacgcccccgagcucccggaggagcgcgagcugaugaccaacugcuccaacaugagccugcggaagguccccgcggaccucacgcccgccaccaccacccuggaccuguccuacaaccuccuguuccagcugcagagcuccgacuuccacagcguguccaagcuccgcgugcugauccugugccacaaccggauccagcagcucgaccugaagacguucgaguucaacaaggagcugcgcuaccucgaccugagcaacaaccggcugaaguccgucaccugguaccuccuggccgggcugcgcuaccucgaccugagcuucaacgacuucgacaccaugcccaucugcgaggaggccggcaacaugucccaccuggagauccucgggcugagcggcgccaagauccagaaguccgacuuccagaagaucgcgcaccuccaccucaacaccguguuccugggguuccggacgcugccgcacuacgaggagggcagccuccccauccugaacaccaccaagcugcacaucgugcuccccauggacaccaacuucuggguccugcugcgcgacggcaucaagacguccaagauccucgagaugaccaacaucgacgggaagucccaguucgugagcuacgagaugcagcggaaccugagccuggagaacgccaagaccuccgugcuccugcugaacaaggucgaccuccugugggacgaccuguuccucauccugcaguucguguggcacaccagcguggagcacuuccagauccgcaacgucacguucggcgggaaggccuaccuggaccacaacagcuucgacuacuccaacaccgugaugcggaccaucaagcucgagcacgugcacuuccgcgucuucuacauccagcaggacaagaucuaccugcugcugaccaagauggacaucgagaaccucacgaucagcaacgcccagaugccccacaugcuguucccgaacuaccccaccaaguuccaguaccugaacuucgcgaacaacauccucaccgacgagcuguucaagcggaccauccagcugccccaccucaagacgcugauccugaacggcaacaagcucgagacccugucccuggugagcugcuucgccaacaacacgccccucgagcaccuggaccugucccagaaccuccugcagcacaagaacgacgagaacugcagcuggccggagaccguggucaacaugaaccuguccuacaacaagcucagcgacuccguguuccgcugccugcccaagagcauccagauccuggaccucaacaacaaccagauccagaccgugcccaaggagaccauccaccugauggcccugcgggagcucaacaucgccuucaacuuccugaccgaccugcccgggugcucccacuucagccgccucuccguccugaacaucgagaugaacuucauccugagcccgucccucgacuucgugcagagcugccaggaggugaagacccugaacgccggccggaaccccuuccgcugcacgugcgagcugaagaacuucauccagcucgagaccuacuccgaggucaugauggugggcuggagcgacuccuacacgugcgaguacccccugaaccugcgggggacccgccucaaggacguccaccuccacgagcugagcugcaacaccgcgcugcugaucgugaccaucguggucaucaugcuggugcucggccuggccguggccuucugcugccugcacuucgaccuccccugguaccugcgcaugcuggggcagugcacccagaccuggcaccggguccgcaagaccacgcaggagcagcucaagcggaacgugcgcuuccacgccuucaucagcuacuccgagcacgacagccugugggugaagaacgagcugaucccgaaccucgagaaggaggacggcuccauccugaucugccuguacgagagcuacuucgaccccggcaaguccaucagcgagaacaucgucuccuucaucgagaaguccuacaagagcaucuucgugcucagccccaacuucgugcagaacgaguggugccacuacgaguucuacuucgcccaccacaaccuguuccacgagaacuccgaccacaucauccugauccuccuggagcccaucccguucuacugcauccccacccgguaccacaagcugaaggcgcuccuggagaagaaggccuaccuggaguggcccaaggaccgccggaagugcgggcuguucugggccaaccugcgcgccgccaucaacgucaacgugcuggcgacccgggagauguacgagcuccagaccuucacggagcugaacgaggagagccgcggcuccaccaucagccugaugcggaccgacugccucuga

SEQ ID NO: 9441 - RNA, 2436 nt, Artificial Sequence
  derived and/or modified sequence opt2 from TLR10__Homo_sapiens__EAW92898
augcgccucauccgcaacaucuacaucuucugcuccaucgucaugaccgccgagggcgacgcccccgagcuccccgaggagcgcgagcucaugaccaacugcuccaacaugucccuccgcaagguccccgccgaccucacccccgccaccaccacccucgaccucuccuacaaccuccucuuccagcuccaguccuccgacuuccacuccgucuccaagcuccgcguccucauccucugccacaaccgcauccagcagcucgaccucaagaccuucgaguucaacaaggagcuccgcuaccucgaccucuccaacaaccgccucaaguccgucaccugguaccuccucgccggccuccgcuaccucgaccucuccuucaacgacuucgacaccaugcccaucugcgaggaggccggcaacaugucccaccucgagauccucggccucuccggcgccaagauccagaaguccgacuuccagaagaucgcccaccuccaccucaacaccgucuuccucggcuuccgcacccucccccacuacgaggagggcucccuccccauccucaacaccaccaagcuccacaucguccuccccauggacaccaacuucuggguccuccuccgcgacggcaucaagaccuccaagauccucgagaugaccaacaucgacggcaagucccaguucgucuccuacgagaugcagcgcaaccucucccucgagaacgccaagaccuccguccuccuccucaacaaggucgaccuccucugggacgaccucuuccucauccuccaguucgucuggcacaccuccgucgagcacuuccagauccgcaacgucaccuucggcggcaaggccuaccucgaccacaacuccuucgacuacuccaacaccgucaugcgcaccaucaagcucgagcacguccacuuccgcgucuucuacauccagcaggacaagaucuaccuccuccucaccaagauggacaucgagaaccucaccaucuccaacgcccagaugccccacaugcucuuccccaacuaccccaccaaguuccaguaccucaacuucgccaacaacauccucaccgacgagcucuucaagcgcaccauccagcucccccaccucaagacccucauccucaacggcaacaagcucgagacccucucccucgucuccugcuucgccaacaacaccccccucgagcaccucgaccucucccagaaccuccuccagcacaagaacgacgagaacugcuccuggcccgagaccgucgucaacaugaaccucuccuacaacaagcucuccgacuccgucuuccgcugccuccccaaguccauccagauccucgaccucaacaacaaccagauccagaccguccccaaggagaccauccaccucauggcccuccgcgagcucaacaucgccuucaacuuccucaccgaccuccccggcugcucccacuucucccgccucuccguccucaacaucgagaugaacuucauccucucccccucccucgacuucguccaguccugccaggaggucaagacccucaacgccggccgcaaccccuuccgcugcaccugcgagcucaagaacuucauccagcucgagaccuacuccgaggucaugauggucggcugguccgacuccuacaccugcgaguacccccucaaccuccgcggcacccgccucaaggacguccaccuccacgagcucuccugcaacaccgcccuccucaucgucaccaucgucgucaucaugcucguccucggccucgccgucgccuucugcugccuccacuucgaccuccccugguaccuccgcaugcucggccagugcacccagaccuggcaccgcguccgcaagaccacccaggagcagcucaagcgcaacguccgcuuccacgccuucaucuccuacuccgagcacgacucccucugggucaagaacgagcucauccccaaccucgagaaggaggacggcuccauccucaucugccucuacgaguccuacuucgaccccggcaaguccaucuccgagaacaucgucuccuucaucgagaaguccuacaaguccaucuucguccucucccccaacuucguccagaacgaguggugccacuacgaguucuacuucgcccaccacaaccucuuccacgagaacuccgaccacaucauccucauccuccucgagcccauccccuucuacugcauccccacccgcuaccacaagcucaaggcccuccucgagaagaaggccuaccucgaguggcccaaggaccgccgcaagugcggccucuucugggccaaccuccgcgccgccaucaacgucaacguccucgccacccgcgagauguacgagcuccagaccuucaccgagcucaacgaggagucccgcggcuccaccaucucccucaugcgcaccgacugccucuga

SEQ ID NO: 9442 - RNA, 2436 nt, Artificial Sequence
  derived and/or modified sequence opt3 from TLR10__Homo_sapiens__EAW92898
augagacugaucaggaacauuuacauauucugcagcaucgugaugaccgccgagggcgacgcucccgaacucccugaggaacgggagcuuaugacaaauuguuccaacaugucucugcgcaaggucccagcagauuugacuccggccacgaccacauuagaccugucauauaaucuacucuuucagcugcaaaguagcgauuuccacuccguuucuaaacuucgagugcugauuuugugccauaaccguauccagcagcucgaccugaagacuuuugaguucaauaaagaacugagauaccucgauuuaucgaacaauaggcugaagucaguaaccugguaucuuuuggcggggcugcgguaccuagaccucagcuuuaacgauuucgacacaaugcccauuugugaggaagcuggaaauaugagucaccuggagauccuuggucuguccggcgccaaaauacagaagucugauuuucaaaagaucgcacauuugcaccucaacaccguguuccugggguuucgcacuuuaccucauuaugaagagggaagccugccaauucucaauacaaccaaacuucacaucguccugcccauggacacgaacuucuggguguugcuaagagauggcauuaagacuuccaaaauccuggagaugaccaauauagacgguaagucacaguuuguuaguuacgaaaugcagaggaaccucagccuggagaaugccaaaacaucugugcuucuguugaacaaggucgaucuccugugggacgacuuauuccugauucuacaguuuguguggcacacuuccguagaacauuuccaaauccggaacguuaccuucgggggaaaggcuuaucucgaucacaauucauuugacuacagcaacacagugaugcgcaccauuaaacuggagcauguccacuuccgaguguuuuacauccagcaggauaagaucuaucuuuugcugacgaaaauggacauugaaaaucucacuauaaguaacgcacagaugccucacaugcuguucccaaauuaccccacaaaguuucaauaucuuaacuucgccaauaacauccugaccgaugaguuguuuaaaagaacuauucagcucccucaucugaagacauuaauccugaauggcaacaaacuagagacccucucucugguguccugcuucgcuaauaacacgccacuugaacacuuggaccugagccagaaucuccugcaacauaagaacgaugagaauuguucguggccggaaaccgucguuaacaugaacuuaucuuacaauaagcuguccgacucaguguuuaggugccuucccaaaaguauacagauuuuggaucucaacaauaaccagauccagacaguaccuaaggagacuauccaccugauggcccuacgggaacugaauauugcguucaacuuucucaccgaccugccaggcuguagccauuucucccgucuuucuguguugaauaucgagaugaacuuuauucugagccccucauuagauuucguccaaaguugccaggaggugaaaacacucaaugcagggcgcaacccuuucagauguacuugcgaacugaagaauuuuauacagcuugagaccuauuccgaaguuaugauggugggauggagcgacucuuacacaugugaguauccacugaacuugagggguacccggcucaaagacguccaucugcacgaacuaucaugcaauacugcccugcucaucgugacgauuguaguuaucaugcuggugcuuggcuuggcugucgccuucugcugucugcacuuugauuuacccugguaccuccgaaugcuggggcagugcacacaaaccuggcaccgcgugagaaagacuacccaggagcagcuuaagaggaacguccgguuccaugcauuuaucaguuacagcgagcacgacucccugugggugaaaaaugaacuaauuccgaaccucgagaaggaagauggaucuauacugaucuguuuguaugagucguacuucgacccuggcaaaagcauuuccgagaacaucguuucauuuauugaaaagaguuauaaaucuaucuucgugcugagccccaauuuuguacagaacgaguggugccacuacgaguucuauuuugcucaucacaauuuauuccaugaaaacuccgaucacauaauccucauucugcuugaaccaaucccuuuuuacuguauucccacacgcuaucauaagcugaaggccuugcucgagaaaaaggcguaccuggaguggccaaaagacagaaggaagugcggucuauucugggccaaucugcgugcagcuaucaacgucaaugugcuugccacccgggaaauguacgagcuccaaacuuucacagaacugaacgaggaaucacgagggagcacgauaucuuugaugagaaccgauugucuguga

SEQ ID NO: 9443 - RNA, 2436 nt, Artificial Sequence
  derived and/or modified sequence opt4 from TLR10__Homo_sapiens__EAW92898
augagacugaucagaaacaucuacaucuucugcagcaucgugaugaccgccgagggcgacgcccccgagcugcccgaggagagagagcugaugaccaacugcagcaacaugagccugagaaaggugcccgccgaccugacccccgccaccaccacccuggaccugagcuacaaccugcuguuccagcugcagagcagcgacuuccacagcgugagcaagcugagagugcugauccugugccacaacagaauccagcagcuggaccugaagaccuucgaguucaacaaggagcugagauaccuggaccugagcaacaacagacugaagagcgugaccugguaccugcuggccggccugagauaccuggaccugagcuucaacgacuucgacaccaugcccaucugcgaggaggccggcaacaugagccaccuggagauccugggccugagcggcgccaagauccagaagagcgacuuccagaagaucgcccaccugcaccugaacaccguguuccugggcuucagaacccugccccacuacgaggagggcagccugcccauccugaacaccaccaagcugcacaucgugcugcccauggacaccaacuucugggugcugcugagagacggcaucaagaccagcaagauccuggagaugaccaacaucgacggcaagagccaguucgugagcuacgagaugcagagaaaccugagccuggagaacgccaagaccagcgugcugcugcugaacaagguggaccugcugugggacgaccuguuccugauccugcaguucguguggcacaccagcguggagcacuuccagaucagaaacgugaccuucggcggcaaggccuaccuggaccacaacagcuucgacuacagcaacaccgugaugagaaccaucaagcuggagcacgugcacuucagaguguucuacauccagcaggacaagaucuaccugcugcugaccaagauggacaucgagaaccugaccaucagcaacgcccagaugccccacaugcuguuccccaacuaccccaccaaguuccaguaccugaacuucgccaacaacauccugaccgacgagcuguucaagagaaccauccagcugccccaccugaagacccugauccugaacggcaacaagcuggagacccugagccuggugagcugcuucgccaacaacaccccccuggagcaccuggaccugagccagaaccugcugcagcacaagaacgacgagaacugcagcuggcccgagaccguggugaacaugaaccugagcuacaacaagcugagcgacagcguguucagaugccugcccaagagcauccagauccuggaccugaacaacaaccagauccagaccgugcccaaggagaccauccaccugauggcccugagagagcugaacaucgccuucaacuuccugaccgaccugcccggcugcagccacuucagcagacugagcgugcugaacaucgagaugaacuucauccugagccccagccuggacuucgugcagagcugccaggaggugaagacccugaacgccggcagaaaccccuucagaugcaccugcgagcugaagaacuucauccagcuggagaccuacagcgaggugaugauggugggcuggagcgacagcuacaccugcgaguacccccugaaccugagaggcaccagacugaaggacgugcaccugcacgagcugagcugcaacaccgcccugcugaucgugaccaucguggugaucaugcuggugcugggccuggccguggccuucugcugccugcacuucgaccugcccugguaccugagaaugcugggccagugcacccagaccuggcacagagugagaaagaccacccaggagcagcugaagagaaacgugagauuccacgccuucaucagcuacagcgagcacgacagccugugggugaagaacgagcugauccccaaccuggagaaggaggacggcagcauccugaucugccuguacgagagcuacuucgaccccggcaagagcaucagcgagaacaucgugagcuucaucgagaagagcuacaagagcaucuucgugcugagccccaacuucgugcagaacgaguggugccacuacgaguucuacuucgcccaccacaaccuguuccacgagaacagcgaccacaucauccugauccugcuggagcccauccccuucuacugcauccccaccagauaccacaagcugaaggcccugcuggagaagaaggccuaccuggaguggcccaaggacagaagaaagugcggccuguucugggccaaccugagagccgccaucaacgugaacgugcuggccaccagagagauguacgagcugcagaccuucaccgagcugaacgaggagagcagaggcagcaccaucagccugaugagaaccgacugccuguga

SEQ ID NO: 9444 - RNA, 2436 nt, Artificial Sequence
  derived and/or modified sequence opt5 from TLR10__Homo_sapiens__EAW92898
augagacugauccggaacauuuacaucuucugcagcauugugaugaccgccgagggcgacgcucccgaacucccugaggaacgcgagcugaugacaaauuguuccaacaugucucuuagaaaggucccggccgaucugacgcccgcgaccacaacccucgaccugagcuauaaucuucuguuucagcuccaauccucugauuuccacagcguuuccaaacugcgggugcugauccucugccauaaccgcauucagcagcuggaccuuaagacauuugaguucaauaaagaacugagauaccucgaucugucuaacaaucggcuuaagagcgugaccugguaucugcucgcugggcugcgcuaccuggaccucuccuuuaacgauuucgacacaaugccuaucugugaggaagccggaaauaugagccaccuggagauccuuggccugucuggggccaaaauucagaaguccgauuuucaaaagaucgcucaucuccaccugaacaccgucuuccuuggauuuagaacgcugccccauuaugaagagggcagccucccuauucugaauaccacaaaacugcacaucgugcuccccauggacaccaacuucuggguucugcuucgggaugggauuaagacaucuaaaauccuggagaugaccaauauugacggaaagucccaguuugugagcuacgaaaugcagcgcaaccucucucuggagaaugccaaaacguccguccuucugcucaacaagguggaucugcugugggacgaccucuuccugauccuucaguuuguuuggcacacaagcguggaacauuuccaaaucagaaacgucaccuucggcggcaaggcuuaucuggaucacaauuccuuugacuacucuaacacagugaugcggaccauuaaacucgagcaugugcacuuccgcgucuuuuacauccagcaggauaagauuuaucugcugcuuaccaaaauggacaucgaaaaucucacaauuagcaacgcccagaugccucacaugcuguucccgaauuaccccacgaaguuucaauaucugaacuucgcgaauaacauccucaccgaugagcuguuuaaaagaacaauccagcuuccucaucugaagacccucauucugaaugggaacaaacuggagacacuuucccucguuagcugcuucgccaauaacacgccccuggaacaccuggaccucucucagaaucugcuucaacauaagaacgaugagaauuguuccuggccugaaaccguggugaacaugaaccugagcuacaauaagcucucugacagcgucuuucggugccugcccaaauccauccagauucuggaucuuaacaauaaccagauccagacagugccgaaggagaccauucaccucauggcucugcgcgaacugaauaucgccuucaacuuucucaccgaccugccuggauguucucauuucagcagacuuuccguucugaauaucgagaugaacuuuauucucagccccucucuggauuucgugcaauccugccaggaggucaaaacacugaaugcuggccggaacccuuucagauguaccugcgaacuuaagaauuuuauccagcucgagacauauagcgaagugaugaugguuggguggucugacuccuacacgugugaguauccccugaaccugcgcggaacccggcucaaagacgugcaccuucacgaacuuagcugcaauacagcccugcucauugucaccaucguggucauuaugcuggugcugggccuugcgguugccuucugcugucugcauuuugaucuccccugguaccugagaaugcucgggcagugcacacaaaccuggcaccgcgugcggaagacgacccaggagcagcugaagagaaacguccgcuuccaugcuuuuaucuccuacucugagcacgacagccuuugggugaaaaaugaacugauuccuaaccucgagaaggaagauggauccauccugaucugucuguaugagucuuacuucgacccgggcaaaagcauuuccgagaacaucguuagcuuuauugaaaagucuuauaaauccaucuucgugcuuagccccaauuuuguccagaacgaguggugccacuacgaguucuauuuugcccaucacaaucuguuccaugaaaacucugaucacauuauccucauccugcucgaaccuauucccuuuuacuguaucccuacacgguaucauaagcugaaggcucugcuggagaaaaaggccuaccucgaguggcccaaagacagacgcaagugcggccuguucugggccaaucugcgggcugcgauuaacgugaaugugcuugccaccagagaaauguacgagcugcaaacauucaccgaacucaacgaggaaucccgcgggagcacgaucucucugaugcggacagauugucucuga

SEQ ID NO: 9445 - protein, 811 aa, Artificial Sequence [sequence omitted]

SEQ ID NO: 9446 - RNA, 2436 nt, Artificial Sequence
  TLR10__Homo_sapiens__AAY78477
augagacucaucagaaacauuuacauauuuuguaguauaguuaugacagcagagggugaugcuccagagcugccagaagaaagggaacugaugaccaacugcuccaacaugucucuaagaaagguucccgcagacuugaccccagccacaacgacacuggauuuauccuauaaccuccuuuuucaacuccagaguucagauuuucauucugucuccaaacugagaguuuugauucuaugccauaacagaauucaacagcuggaucucaaaaccuuugaauucaacaaggaguuaagauauuuagauuugucuaauaacagacugaagaguguaacuugguauuuacuggcaggucucagguauuuagaucuuucuuuuaaugacuuugacaccaugccuaucugugaggaagcuggcaacaugucacaccuggaaauccuagguuugaguggggcaaaaauacaaaaaucagauuuccagaaaauugcucaucugcaucuaaauacugucuucuuaggauucagaacucuuccucauuaugaagaagguagccugcccaucuuaaacacaacaaaacugcacauuguuuuaccaauggacacaaauuucuggguucuuuugcgugauggaaucaagacuucaaaaauauuagaaaugacaaauauagauggcaaaagccaauuuguaaguuaugaaaugcaacgaaaucuuaguuuagaacaugcuaagacaucgguucuauugcuuaauaaaguugauuuacucugggacgaccuuuuccuuaucuuacaauuuguuuggcauacaucaguggaacacuuucagauccgaaaugugacuuuuggugguaaggcuuaucuugaccacaauucauuugacuacucaaauacuguaaugagaacuauaaaguuggagcauguacauuucagaguguuuuacauucaacaggauaaaaucuauuugcuuuugaccaaaauggacauagaaaaccugacaauaucaaaugcacaaaugccacacaugcuuuucccgaauuauccuacgaaauuccaauauuuaaauuuugccaauaauaucuuaacagacgaguuguuuaaaagaacucuccaacugccucacuugaaaacucucauuuugaauggcaauaaacuggagacacuuucuuuaguaaguugcuuugcuaacaacacacccuuggaacacuuggaucugagucaaaaucuauuacaacauaaaaaugaugaaaauugcucauggccagaaacuguggucaauaugaaucugucauacaauaaauugucugauucugucuucaggugcuugcccaaaaguauucaaauacuugaccuaaauaauaaccaaauccaaacuguaccuaaagagacuauucaucugauggccuuacgagaacuaaauauugcauuuaauuuucuaacugaucucccuggaugcagucauuucaguagacuuucaguucugaacauugaaaugaacuucauucucagcccaucucuggauuuuguucagagcugccaggaaguuaaaacucuaaaugcgggaagaaauccauuccgguguaccugugaauuaaaaaauuucauucagcuugaaacauauucagaggucaugaugguuggauggucagauucauacaccugugaauacccuuuaaaccuaaggggaacuagguuaaaagacguucaucuccacgaauuaucuugcaacacagcucuguugauugucaccauugugguuauuaugcuaguucugggguuggcuguggccuucugcugucuccacuuugaucugcccugguaucucaggaugcuaggucaaugcacacaaacauggcacaggguuaggaaaacaacccaagaacaacucaagagaaauguccgauuccacgcauuuauuucauacagugaacaugauucucugugggugaagaaugaauugauccccaaucuagagaaggaagaugguucuaucuugauuugccuuuaugaaagcuacuuugacccuggcaaaagcauuagugaaaauauuguaagcuucauugagaaaagcuauaaguccaucuuuguuuugucucccaacuuuguccagaaugaguggugccauuaugaauucuacuuugcccaccacaaucucuuccaugaaaauucugaucauauaauucuuaucuuacuggaacccauuccauucuauugcauucccaccagguaucauaaacugaaagcucuccuggaaaaaaaagcauacuuggaauggcccaaggauaggcguaaaugugggcuuuucugggcaaaccuucgagcugcuauuaauguuaauguauuagccaccagagaaauguaugaacugcagacauucacagaguuaaaugaagagucucgagguucuacaaucucucugaugagaacagauugucuauaa

SEQ ID NO: 9447 - RNA, 2436 nt, Artificial Sequence
  derived and/or modified sequence opt1 from TLR10__Homo_sapiens__AAY78477
augcgccugauccggaacaucuacaucuucugcagcaucgugaugaccgccgagggcgacgcccccgagcucccggaggagcgcgagcugaugaccaacugcuccaacaugagccugcggaagguccccgcggaccucacgcccgccaccaccacccuggaccuguccuacaaccuccuguuccagcugcagagcuccgacuuccacagcguguccaagcuccgcgugcugauccugugccacaaccggauccagcagcucgaccugaagacguucgaguucaacaaggagcugcgcuaccucgaccugagcaacaaccggcugaaguccgucaccugguaccuccuggccgggcugcgcuaccucgaccugagcuucaacgacuucgacaccaugcccaucugcgaggaggccggcaacaugucccaccuggagauccucgggcugagcggcgccaagauccagaaguccgacuuccagaagaucgcgcaccuccaccugaacaccguguuccugggguuccggacgcugccgcacuacgaggagggcagccuccccauccugaacaccaccaagcugcacaucgugcuccccauggacaccaacuucuggguccugcugcgcgacggcaucaagacguccaagauccucgagaugaccaacaucgacgggaagucccaguucgugagcuacgagaugcagcggaaccugagccuggagcacgccaagaccuccgugcuccugcugaacaaggucgaccuccugugggacgaccuguuccucauccugcaguucguguggcacaccagcguggagcacuuccagauccgcaacgucacguucggcgggaaggccuaccuggaccacaacagcuucgacuacuccaacaccgugaugcggaccaucaagcucgagcacgugcacuuccgcgucuucuacauccagcaggacaagaucuaccugcugcugaccaagauggacaucgagaaccucacgaucagcaacgcccagaugccccacaugcuguucccgaacuaccccaccaaguuccaguaccugaacuucgcgaacaacauccucaccgacgagcuguucaagcggacccugcagcucccccaccugaagacgcugauccucaacggcaacaagcuggagacccugucccucgugagcugcuucgccaacaacacgccccuggagcaccuggaccucucccagaaccugcugcagcacaagaacgacgagaacugcagcuggccggagaccguggucaacaugaaccucuccuacaacaagcugagcgacuccguguuccgcugccugcccaagagcauccagauccucgaccugaacaacaaccagauccagaccgugcccaaggagaccauccaccugauggcccuccgggagcugaacaucgccuucaacuuccugaccgaccuccccgggugcucccacuucagccgccuguccguccugaacaucgagaugaacuucauccucagcccgucccuggacuucgugcagagcugccaggaggugaagacccugaacgccggccggaaccccuuccgcugcacgugcgagcucaagaacuucauccagcuggagaccuacuccgaggucaugauggugggcuggagcgacuccuacacgugcgaguacccccugaaccuccgggggacccgccugaaggacguccaccuccacgagcugagcugcaacaccgcgcugcugaucgugaccaucguggucaucaugcucgugcugggccuggccguggccuucugcugccuccacuucgaccugcccugguaccugcgcaugcucgggcagugcacccagaccuggcaccggguccgcaagaccacgcaggagcagcugaagcggaacgugcgcuuccacgccuucaucagcuacuccgagcacgacagccugugggugaagaacgagcucaucccgaaccuggagaaggaggacggcuccauccugaucugccucuacgagagcuacuucgaccccggcaaguccaucagcgagaacaucgucuccuucaucgagaaguccuacaagagcaucuucgugcugagccccaacuucgugcagaacgaguggugccacuacgaguucuacuucgcccaccacaaccuguuccacgagaacuccgaccacaucauccucauccugcuggagcccaucccguucuacugcauccccacccgguaccacaagcucaaggcgcugcuggagaagaaggccuaccucgaguggcccaaggaccgccggaagugcgggcuguucugggccaaccugcgcgccgccaucaacgucaacgugcucgcgacccgggagauguacgagcugcagaccuucacggagcugaacgaggagagccgcggcuccaccaucagccucaugcggaccgacugccuguga

SEQ ID NO: 9448 - RNA, 2436 nt, Artificial Sequence
  derived and/or modified sequence opt2 from TLR10__Homo_sapiens__AAY78477
augcgccucauccgcaacaucuacaucuucugcuccaucgucaugaccgccgagggcgacgcccccgagcuccccgaggagcgcgagcucaugaccaacugcuccaacaugucccuccgcaagguccccgccgaccucacccccgccaccaccacccucgaccucuccuacaaccuccucuuccagcuccaguccuccgacuuccacuccgucuccaagcuccgcguccucauccucugccacaaccgcauccagcagcucgaccucaagaccuucgaguucaacaaggagcuccgcuaccucgaccucuccaacaaccgccucaaguccgucaccugguaccuccucgccggccuccgcuaccucgaccucuccuucaacgacuucgacaccaugcccaucugcgaggaggccggcaacaugucccaccucgagauccucggccucuccggcgccaagauccagaaguccgacuuccagaagaucgcccaccuccaccucaacaccgucuuccucggcuuccgcacccucccccacuacgaggagggcucccuccccauccucaacaccaccaagcuccacaucguccuccccauggacaccaacuucuggguccuccuccgcgacggcaucaagaccuccaagauccucgagaugaccaacaucgacggcaagucccaguucgucuccuacgagaugcagcgcaaccucucccucgagcacgccaagaccuccguccuccuccucaacaaggucgaccuccucugggacgaccucuuccucauccuccaguucgucuggcacaccuccgucgagcacuuccagauccgcaacgucaccuucggcggcaaggccuaccucgaccacaacuccuucgacuacuccaacaccgucaugcgcaccaucaagcucgagcacguccacuuccgcgucuucuacauccagcaggacaagaucuaccuccuccucaccaagauggacaucgagaaccucaccaucuccaacgcccagaugccccacaugcucuuccccaacuaccccaccaaguuccaguaccucaacuucgccaacaacauccucaccgacgagcucuucaagcgcacccuccagcucccccaccucaagacccucauccucaacggcaacaagcucgagacccucucccucgucuccugcuucgccaacaacaccccccucgagcaccucgaccucucccagaaccuccuccagcacaagaacgacgagaacugcuccuggcccgagaccgucgucaacaugaaccucuccuacaacaagcucuccgacuccgucuuccgcugccuccccaaguccauccagauccucgaccucaacaacaaccagauccagaccguccccaaggagaccauccaccucauggcccuccgcgagcucaacaucgccuucaacuuccucaccgaccuccccggcugcucccacuucucccgccucuccguccucaacaucgagaugaacuucauccucucccccucccucgacuucguccaguccugccaggaggucaagacccucaacgccggccgcaaccccuuccgcugcaccugcgagcucaagaacuucauccagcucgagaccuacuccgaggucaugauggucggcugguccgacuccuacaccugcgaguacccccucaaccuccgcggcacccgccucaaggacguccaccuccacgagcucuccugcaacaccgcccuccucaucgucaccaucgucgucaucaugcucguccucggccucgccgucgccuucugcugccuccacuucgaccuccccugguaccuccgcaugcucggccagugcacccagaccuggcaccgcguccgcaagaccacccaggagcagcucaagcgcaacguccgcuuccacgccuucaucuccuacuccgagcacgacucccucugggucaagaacgagcucauccccaaccucgagaaggaggacggcuccauccucaucugccucuacgaguccuacuucgaccccggcaaguccaucuccgagaacaucgucuccuucaucgagaaguccuacaaguccaucuucguccucucccccaacuucguccagaacgaguggugccacuacgaguucuacuucgcccaccacaaccucuuccacgagaacuccgaccacaucauccucauccuccucgagcccauccccuucuacugcauccccacccgcuaccacaagcucaaggcccuccucgagaagaaggccuaccucgaguggcccaaggaccgccgcaagugcggccucuucugggccaaccuccgcgccgccaucaacgucaacguccucgccacccgcgagauguacgagcuccagaccuucaccgagcucaacgaggagucccgcggcuccaccaucucccucaugcgcaccgacugccucuga

SEQ ID NO: 9449 - RNA, 2436 nt, Artificial Sequence
  derived and/or modified sequence opt3 from TLR10__Homo_sapiens__AAY78477
augagacugaucaggaacauuuacauauucugcagcaucgugaugaccgccgagggcgacgcucccgaacucccugaggaacgggagcuuaugacaaauuguuccaacaugucucugcgcaaggucccagcagauuugacuccggccacgaccacauuagaccugucauauaaucuacucuuucagcugcaaaguagcgauuuccacuccguuucuaaacuucgagugcugauuuugugccauaaccguauccagcagcucgaccugaagacuuuugaauuuaauaaagagcugagauaccucgauuuaucgaacaauaggcugaagucaguaaccugguaucuuuuggcggggcugcgguaccuagaccucagcuucaacgauuucgacacaaugcccauuugugaggaagcuggaaauaugagucaccuggagauccuuggucuguccggcgccaaaauacagaagucugauuuucaaaagaucgcacauuugcaccucaacaccguguuccugggguuucgcacuuuaccucauuaugaagagggaagccugccaauucucaauacaaccaaacuucacaucguccugcccauggacacgaacuucuggguguugcuaagagauggcauuaagacuuccaaaauccuggagaugaccaauauagacgguaagucacaguuuguuaguuacgaaaugcagaggaaccucagccuggagcacgccaaaacaucugugcuucuguugaauaaggucgaucuccugugggacgacuuauuccugauucuacaguuuguguggcauacuuccguagaacacuuccaaauccggaacguuaccuucgggggaaaggcuuaucucgaucauaacucauuugacuacagcaauacagugaugcgcaccauuaaacuggagcacguccacuuccgaguguuuuacauccagcaggauaagaucuaucuuuugcugacgaaaauggacauugaaaaccucacuauaaguaaugcacagaugccucauaugcuguucccaaacuaccccacaaaguuucaauaucuuaauuucgccaacaauauccugaccgaugaguuguuuaaaagaacucuccagcugccucacuuaaagacacugauucuaaacggcaauaaacucgagacccugucucuuguguccugcuucgcuaacaauacgccauuggaacaucuggaccucagccagaaccuguuacaacacaagaaugaugagaacuguucguggccggaaaccgucguuaauaugaaccugucuuacaacaaacuuuccgacucaguguuuaggugcuugcccaagaguauccagauacucgaucugaauaacaaucagauucagacaguaccuaaggagacuauccaucuaauggcccugcgggaacucaacaucgcguucaauuuucugaccgaccuuccaggcuguagccacuucucccguuugucugugcugaacauugagaugaauuuuaucuuaagccccucacucgauuucguccaaaguugccaggaggugaaaacacugaacgcagggcgcaauccuuucagauguacuugcgaacuuaagaacuuuauucagcuggagaccuauuccgaaguuaugauggugggauggagcgacucuuacacaugugaguauccauugaaucucagggguacccggcugaaagacguccaccuacaugaacugucaugcaacacugcccuccugauagugacgaucguaguuauuaugcuuguguugggccuggcugucgccuucugcuguuuacacuuugaucuccccugguaccugcgaaugcuugggcagugcacacaaaccuggcaucgcgugagaaagacuacccaggagcagcugaagaggaauguccgguuccacgcauuuaucaguuacagcgagcacgacucccuaugggugaaaaacgaacucaucccgaaucuggagaaggaagauggaucuauuuugauaugucuguaugagucguacuucgacccuggcaaaagcaucuccgagaacauuguuucauuuaucgaaaagaguuauaaaucuauuuucguguuaagccccaacuuuguacagaaugaguggugccauuacgaguucuauuuugcucaccauaaccucuuccacgaaaauuccgaucauaucauacugauccuucuggaaccaauuccuuuuuacuguauccccacacgcuaucacaaguugaaggcccuccuggagaaaaaggcguaccuagaguggccaaaagacagaaggaagugcggucuguucugggccaaccuucgugcagcuauuaaugucaacgugcucgccacccgggaaauguacgagcugcaaacuuucacagaauugaaugaggaaucacgagggagcacgaucucucugaugagaaccgauuguuuauga

SEQ ID NO: 9450 - RNA, 2436 nt, Artificial Sequence
  derived and/or modified sequence opt4 from TLR10__Homo_sapiens__AAY78477
augagacugaucagaaacaucuacaucuucugcagcaucgugaugaccgccgagggcgacgcccccgagcugcccgaggagagagagcugaugaccaacugcagcaacaugagccugagaaaggugcccgccgaccugacccccgccaccaccacccuggaccugagcuacaaccugcuguuccagcugcagagcagcgacuuccacagcgugagcaagcugagagugcugauccugugccacaacagaauccagcagcuggaccugaagaccuucgaguucaacaaggagcugagauaccuggaccugagcaacaacagacugaagagcgugaccugguaccugcuggccggccugagauaccuggaccugagcuucaacgacuucgacaccaugcccaucugcgaggaggccggcaacaugagccaccuggagauccugggccugagcggcgccaagauccagaagagcgacuuccagaagaucgcccaccugcaccugaacaccguguuccugggcuucagaacccugccccacuacgaggagggcagccugcccauccugaacaccaccaagcugcacaucgugcugcccauggacaccaacuucugggugcugcugagagacggcaucaagaccagcaagauccuggagaugaccaacaucgacggcaagagccaguucgugagcuacgagaugcagagaaaccugagccuggagcacgccaagaccagcgugcugcugcugaacaagguggaccugcugugggacgaccuguuccugauccugcaguucguguggcacaccagcguggagcacuuccagaucagaaacgugaccuucggcggcaaggccuaccuggaccacaacagcuucgacuacagcaacaccgugaugagaaccaucaagcuggagcacgugcacuucagaguguucuacauccagcaggacaagaucuaccugcugcugaccaagauggacaucgagaaccugaccaucagcaacgcccagaugccccacaugcuguuccccaacuaccccaccaaguuccaguaccugaacuucgccaacaacauccugaccgacgagcuguucaagagaacccugcagcugccccaccugaagacccugauccugaacggcaacaagcuggagacccugagccuggugagcugcuucgccaacaacaccccccuggagcaccuggaccugagccagaaccugcugcagcacaagaacgacgagaacugcagcuggcccgagaccguggugaacaugaaccugagcuacaacaagcugagcgacagcguguucagaugccugcccaagagcauccagauccuggaccugaacaacaaccagauccagaccgugcccaaggagaccauccaccugauggcccugagagagcugaacaucgccuucaacuuccugaccgaccugcccggcugcagccacuucagcagacugagcgugcugaacaucgagaugaacuucauccugagccccagccuggacuucgugcagagcugccaggaggugaagacccugaacgccggcagaaaccccuucagaugcaccugcgagcugaagaacuucauccagcuggagaccuacagcgaggugaugauggugggcuggagcgacagcuacaccugcgaguacccccugaaccugagaggcaccagacugaaggacgugcaccugcacgagcugagcugcaacaccgcccugcugaucgugaccaucguggugaucaugcuggugcugggccuggccguggccuucugcugccugcacuucgaccugcccugguaccugagaaugcugggccagugcacccagaccuggcacagagugagaaagaccacccaggagcagcugaagagaaacgugagauuccacgccuucaucagcuacagcgagcacgacagccugugggugaagaacgagcugauccccaaccuggagaaggaggacggcagcauccugaucugccuguacgagagcuacuucgaccccggcaagagcaucagcgagaacaucgugagcuucaucgagaagagcuacaagagcaucuucgugcugagccccaacuucgugcagaacgaguggugccacuacgaguucuacuucgcccaccacaaccuguuccacgagaacagcgaccacaucauccugauccugcuggagcccauccccuucuacugcauccccaccagauaccacaagcugaaggcccugcuggagaagaaggccuaccuggaguggcccaaggacagaagaaagugcggccuguucugggccaaccugagagccgccaucaacgugaacgugcuggccaccagagagauguacgagcugcagaccuucaccgagcugaacgaggagagcagaggcagcaccaucagccugaugagaaccgacugccuguga

SEQ ID NO: 9451 - RNA, 2436 nt, Artificial Sequence
  derived and/or modified sequence opt5 from TLR10__Homo_sapiens__AAY78477
augagacugauccggaacauuuacaucuucugcagcauugugaugaccgccgagggcgacgcucccgaacucccugaggaacgcgagcugaugacaaauuguuccaacaugucucuuagaaaggucccggccgaucugacgcccgcgaccacaacccucgaccugagcuauaaucuucuguuucagcuccaauccucugauuuccacagcguuuccaaacugcgggugcugauccucugccauaaccgcauucagcagcuggaccuuaagacauuugaguucaauaaagagcugagauaccucgaucugucuaacaaucggcuuaagagcgugaccugguaucugcucgcugggcugcgcuaccuggaccucuccuuuaacgauuucgacacaaugccuaucugugaggaagccggaaauaugagccaccuggagauccuuggccugucuggggccaaaauucagaaguccgauuuucaaaagaucgcucaucuccaccugaacaccgucuuccuuggauuuagaacgcugccccauuaugaagagggcagccucccuauucugaauaccacaaaacugcacaucgugcuccccauggacaccaacuucuggguucugcuucgggaugggauuaagacaucuaaaauccuggagaugaccaauauugacggaaagucccaguuugugagcuacgaaaugcagcgcaaccucucucuggagcacgccaaaacguccguccuucugcucaauaagguggaucugcugugggacgaccucuuccugauccuucaguuuguuuggcauacaagcguggaacacuuccaaaucagaaacgucaccuucggcggcaaggcuuaucuggaucauaacuccuuugacuacucuaauacagugaugcggaccauuaaacucgagcacgugcacuuccgcgucuuuuacauccagcaggauaagauuuaucugcugcuuaccaaaauggacaucgaaaaccucacaauuagcaaugcccagaugccucauaugcuguucccgaacuaccccacgaaguuucaauaucugaauuucgcgaacaauauccucaccgaugagcuguuuaaaagaacacuucagcugccucaccucaagacccugauccugaacgggaauaaacuugagacacucucccugguuagcugcuucgccaacaauacgccccuggaacaucucgaccugucucagaaccuucugcaacacaagaaugaugagaacuguuccuggccugaaaccguggugaauaugaaccucagcuacaacaagcugucugacagcgucuuucggugccugcccaaauccauucagauccuugaucucaauaacaaucagauucagacagugccgaaggagaccauccaucugauggcucugcgcgaacucaacauugccuucaauuuucugaccgaccuuccuggauguucucacuucagcagacuguccguucucaacaucgagaugaauuuuauccugagccccucucuggauuucgugcaauccugccaggaggucaaaacacuuaacgcuggccggaauccuuucagauguaccugcgaacucaagaacuuuauucagcuggagacauauagcgaagugaugaugguuggguggucugacuccuacacgugugaguauccccugaaucuccgcggaacccggcugaaagacgugcaccuucaugaacugagcugcaacacagcccuccugaucgucaccauuguggucaucaugcuggugcuuggccuggcgguugccuucugcugucuccacuuugaucugcccugguaccucagaaugcuggggcagugcacacaaaccuggcaucgcgugcggaagacgacccaggagcagcuuaagagaaauguccgcuuccacgcuuuuauuuccuacucugagcacgacagccugugggugaaaaacgaacucaucccuaaucuggagaaggaagauggauccauucugaucugucuuuaugagucuuacuucgacccgggcaaaagcaucuccgagaacauuguuagcuuuaucgaaaagucuuauaaauccauuuucgugcugagccccaacuuuguccagaaugaguggugccauuacgaguucuauuuugcccaccauaaccucuuccacgaaaauucugaucauaucauucugauccuccuggaaccuauccccuuuuacuguauuccuacacgguaucacaaacuuaaggcucugcucgaaaagaaggccuaccuggaguggcccaaagacagacgcaagugcggccuguucugggccaaccuucgggcugcgaucaaugugaacgugcuggccaccagagaaauguacgagcuccaaacauucaccgaacugaaugaggaaucccgcgggagcacgauuucucucaugcggacagauugucuguga

SEQ ID NO: 9452 - protein, 811 aa, Artificial Sequence [sequence omitted]

SEQ ID NO: 9453 - RNA, 2436 nt, Artificial Sequence
  TLR10__Homo_sapiens__AAY78478
augagacucaucagaaacauuuacauauuuuguaguauaguuaugacagcagagggugaugcuccagagcugccagaagaaagggaacugaugaccaacugcuccaacaugucucuaagaaagguucccgcagacuugaccccagccacaacaacacuggauuuauccuauaaccuccuuuuucaacuccagaguucagauuuucauucugucuccaaacugagaguuuugauucuaugccauaacagaauucaacagcuggaucucaaaaccuuugaauucaacaaggaguuaagauauuuagauuugucuaauaacagacugaagaguguaacuugguauuuacuggcaggucucagguauuuagaucuuucuuuuaaugacuuugacaccaugccuaucugugaggaagcuggcaacaugucacaccuggaaauccuagguuugaguggggcaaaaauacaaaaaucagauuuccagaaaauuucucaucugcaucuaaauacugucuucuuaggauucagaacucuuccucauuaugaagaagguagccugcccaucuuaaacacaacaaaacugcacauuguuuuaccaauggacacaaauuucuggguucuuuugcgugauggaaucaagacuucaaaaauauuagaaaugacaaauauagauggcaaaagccaauuuguaaguuaugaaaugcaacgaaaucuuaguuuagaaaaugcuaagacaucgguucuauugcuuaauaaaguugauuuacucugggacgaccuuuuccuuaucuuacaauuuguuuggcauacaucaguggaacacuuucagauccgaaaugugacuuuuggugguaaggcuuaucuugaccacaauucauuugacuacucaaauacuguaaugagaacuauaaaauuggagcauguacauuucagaguguuuuacauucaacaggauaaaaucuauuugcuuuugaccaaaacggacauagaaaaccugacaauaucaaaugcacaaaugccacacaugcuuuucccuaauuauccuacgaaauuccaauauuuaaauuuugccaauaauaucuuaacagacgaguuguuuaaaagaacucuccaacugccucacuugaaaacucucauuuugaauggcaauaaacuggagacacuuucuuuaguaaguugcuuugcuaacaacacacccuuggaacacuuggaucugagucaaaaucuauuacaacauaaaaaugaugaaaauugcucauggccagaaacuguggucaauaugaaucugucauacaauaaauugucugauucugucuucaggugcuugcccaaaaguauucaaauacuugaccuaaauaauaaccaaauccaaacuguaccuaaagagacuauucaucugauggccuuacgagaacuaaauauugcauuuaauuuucuaacugaucucccuggaugcagucauuucaguagacuuucaguucugaacauugaaaugaacuucauucucagcccaucucuggauuuuguucagagcugccaggaaguuaaaacucuaaaugcgggaagaaauccauuccgguguaccugugaauuaaaaaauuucauucagcuugaaacauauucagaggucaugaugguuggauggucagauucauacaccugugaauacccuuuaaaccuaaggggaacuagguuaaaagacguucaucuccacgaauuaucuugcaacacagcucuguugauugucaccauugugguuauuaugcuaguucugggguuggcuguggccuucugcugucuccacuuugaucugcccugguaucucaggaugcuaggucaaugcacacaaacauggcacaggguuaggaaaacaacccaagaacaacucaagagaaauguccgauuccacgcauuuauuucauacagugaacaugauucucugugggugaagaaugaauugauccccaaucuagagaaggaagaugguucuaucuugauuugccuuuaugaaagcuacuuugacccuggcaaaagcauuagugaaaauauuguaagcuucauugagaaaagcuauaaguccaucuuuguuuugucucccaacuuuguccagaaugaguggugccauuaugaauucuacuuugcccaccacaaucucuuccaugaaaauucugaucacauaauucuuaucuuacuggaacccauuccauucuauugcauucccaccagguaucauaaacugaaagcucuccuggaaaaaaaagcauacuuggaauggcccaaggauaggcguaaaugugggcuuuucugggcaaaccuucgagcugcuauuaauguuaauguauuagccaccagagaaauguaugaacugcagacauucacagaguuaaaugaagagucucgagguucuacaaucucucugaugagaacagacugucuauaa

SEQ ID NO: 9454 - RNA, 2436 nt, Artificial Sequence
  derived and/or modified sequence opt1 from TLR10__Homo_sapiens__AAY78478
augcgccugauccggaacaucuacaucuucugcagcaucgugaugaccgccgagggcgacgcccccgagcucccggaggagcgcgagcugaugaccaacugcuccaacaugagccugcggaagguccccgcggaccucacgcccgccaccaccacccuggaccuguccuacaaccuccuguuccagcugcagagcuccgacuuccacagcguguccaagcuccgcgugcugauccugugccacaaccggauccagcagcucgaccugaagacguucgaguucaacaaggagcugcgcuaccucgaccugagcaacaaccggcugaaguccgucaccugguaccuccuggccgggcugcgcuaccucgaccugagcuucaacgacuucgacaccaugcccaucugcgaggaggccggcaacaugucccaccuggagauccucgggcugagcggcgccaagauccagaaguccgacuuccagaagaucagccaccuccaccugaacaccguguuccugggguuccggacgcugccgcacuacgaggagggcucccuccccauccugaacaccaccaagcugcacaucgugcuccccauggacaccaacuucuggguccugcugcgcgacggcaucaagacgagcaagauccucgagaugaccaacaucgacgggaagucccaguucgugagcuacgagaugcagcggaaccugucccuggagaacgcgaagaccagcgugcuccugcugaacaaggucgaccuccugugggacgaccuguuccucauccugcaguucguguggcacaccagcguggagcacuuccagauccgcaacgucacguucggcgggaaggccuaccuggaccacaacuccuucgacuacagcaacaccgugaugcggaccaucaagcucgagcacgugcacuuccgcgucuucuacauccagcaggacaagaucuaccugcugcugaccaagacggacaucgagaaccucaccaucuccaacgcccagaugccccacaugcuguucccgaacuaccccaccaaguuccaguaccugaacuucgccaacaacauccucaccgacgagcuguucaagcggacgcugcagcucccccaccugaagacccugauccucaacggcaacaagcuggagacccugagccucguguccugcuucgcgaacaacacgccccuggagcaccuggaccucagccagaaccugcugcagcacaagaacgacgagaacugcuccuggccggagaccguggucaacaugaaccucagcuacaacaagcuguccgacagcguguuccgcugccugcccaaguccauccagauccucgaccugaacaacaaccagauccagaccgugcccaaggagaccauccaccugauggcccuccgggagcugaacaucgccuucaacuuccugaccgaccuccccgggugcagccacuucucccgccugagcguccugaacaucgagaugaacuucauccucuccccgagccuggacuucgugcaguccugccaggaggugaagacgcugaacgccggccggaaccccuuccgcugcacgugcgagcucaagaacuucauccagcuggagaccuacagcgaggucaugauggugggcugguccgacagcuacacgugcgaguacccccugaaccuccgggggacccgccugaaggacguccaccuccacgagcugagcugcaacaccgcccugcugaucgugaccaucguggucaucaugcucgugcugggccuggcgguggccuucugcugccuccacuucgaccugcccugguaccugcgcaugcucgggcagugcacccagaccuggcaccggguccgcaagaccacccaggagcagcugaagcggaacgugcgcuuccacgccuucaucuccuacagcgagcacgacucccugugggugaagaacgagcucaucccgaaccuggagaaggaggacggcagcauccugaucugccucuacgaguccuacuucgaccccggcaagagcaucuccgagaacaucgucagcuucaucgagaaguccuacaagagcaucuucgugcugucccccaacuucgugcagaacgaguggugccacuacgaguucuacuucgcccaccacaaccuguuccacgagaacagcgaccacaucauccucauccugcuggagcccaucccguucuacugcauccccacccgguaccacaagcucaaggcccugcuggagaagaaggcguaccucgaguggcccaaggaccgccggaagugcgggcuguucugggccaaccugcgcgccgccaucaacgucaacgugcucgccacccgggagauguacgagcugcagacguucaccgagcugaacgaggagucccgcggcagcaccaucucccucaugcggaccgacugccuguga

SEQ ID NO: 9455 - RNA, 2436 nt, Artificial Sequence
  derived and/or modified sequence opt2 from TLR10__Homo_sapiens__AAY78478
augcgccucauccgcaacaucuacaucuucugcuccaucgucaugaccgccgagggcgacgcccccgagcuccccgaggagcgcgagcucaugaccaacugcuccaacaugucccuccgcaagguccccgccgaccucacccccgccaccaccacccucgaccucuccuacaaccuccucuuccagcuccaguccuccgacuuccacuccgucuccaagcuccgcguccucauccucugccacaaccgcauccagcagcucgaccucaagaccuucgaguucaacaaggagcuccgcuaccucgaccucuccaacaaccgccucaaguccgucaccugguaccuccucgccggccuccgcuaccucgaccucuccuucaacgacuucgacaccaugcccaucugcgaggaggccggcaacaugucccaccucgagauccucggccucuccggcgccaagauccagaaguccgacuuccagaagaucucccaccuccaccucaacaccgucuuccucggcuuccgcacccucccccacuacgaggagggcucccuccccauccucaacaccaccaagcuccacaucguccuccccauggacaccaacuucuggguccuccuccgcgacggcaucaagaccuccaagauccucgagaugaccaacaucgacggcaagucccaguucgucuccuacgagaugcagcgcaaccucucccucgagaacgccaagaccuccguccuccuccucaacaaggucgaccuccucugggacgaccucuuccucauccuccaguucgucuggcacaccuccgucgagcacuuccagauccgcaacgucaccuucggcggcaaggccuaccucgaccacaacuccuucgacuacuccaacaccgucaugcgcaccaucaagcucgagcacguccacuuccgcgucuucuacauccagcaggacaagaucuaccuccuccucaccaagaccgacaucgagaaccucaccaucuccaacgcccagaugccccacaugcucuuccccaacuaccccaccaaguuccaguaccucaacuucgccaacaacauccucaccgacgagcucuucaagcgcacccuccagcucccccaccucaagacccucauccucaacggcaacaagcucgagacccucucccucgucuccugcuucgccaacaacaccccccucgagcaccucgaccucucccagaaccuccuccagcacaagaacgacgagaacugcuccuggcccgagaccgucgucaacaugaaccucuccuacaacaagcucuccgacuccgucuuccgcugccuccccaaguccauccagauccucgaccucaacaacaaccagauccagaccguccccaaggagaccauccaccucauggcccuccgcgagcucaacaucgccuucaacuuccucaccgaccuccccggcugcucccacuucucccgccucuccguccucaacaucgagaugaacuucauccucucccccucccucgacuucguccaguccugccaggaggucaagacccucaacgccggccgcaaccccuuccgcugcaccugcgagcucaagaacuucauccagcucgagaccuacuccgaggucaugauggucggcugguccgacuccuacaccugcgaguacccccucaaccuccgcggcacccgccucaaggacguccaccuccacgagcucuccugcaacaccgcccuccucaucgucaccaucgucgucaucaugcucguccucggccucgccgucgccuucugcugccuccacuucgaccuccccugguaccuccgcaugcucggccagugcacccagaccuggcaccgcguccgcaagaccacccaggagcagcucaagcgcaacguccgcuuccacgccuucaucuccuacuccgagcacgacucccucugggucaagaacgagcucauccccaaccucgagaaggaggacggcuccauccucaucugccucuacgaguccuacuucgaccccggcaaguccaucuccgagaacaucgucuccuucaucgagaaguccuacaaguccaucuucguccucucccccaacuucguccagaacgaguggugccacuacgaguucuacuucgcccaccacaaccucuuccacgagaacuccgaccacaucauccucauccuccucgagcccauccccuucuacugcauccccacccgcuaccacaagcucaaggcccuccucgagaagaaggccuaccucgaguggcccaaggaccgccgcaagugcggccucuucugggccaaccuccgcgccgccaucaacgucaacguccucgccacccgcgagauguacgagcuccagaccuucaccgagcucaacgaggagucccgcggcuccaccaucucccucaugcgcaccgacugccucuga

SEQ ID NO: 9456 - RNA, 2436 nt, Artificial Sequence
  derived and/or modified sequence opt3 from TLR10__Homo_sapiens__AAY78478
augagacugaucaggaacauuuacauauucugcagcaucgugaugaccgccgagggcgacgcucccgaacucccugaggaacgggagcuuaugacaaauuguuccaacaugucucugcgcaaggucccagcagauuugacuccggccacgaccacauuagaccugucauauaaucuacucuuucagcugcaaaguagcgauuuccacuccguuucuaaacuucgagugcugauuuugugccauaaccguauccagcagcucgaccugaagacuuuugaguucaauaaagaacugagauaccucgauuuaucgaacaauaggcugaagucaguaaccugguaucuuuuggcggggcugcgguaccuagaccucagcuuuaacgauuucgacacaaugcccauuugugaggaagcuggaaauaugagucaccuggagauccuuggucuguccggcgccaaaauacagaagucugauuuucaaaagaucagccauuugcaccucaacaccguguuccugggguuucgcacuuuaccucauuaugaagagggaucccugccaauucucaauacaaccaaacuucacaucguccugcccauggacacgaacuucuggguguugcuaagagauggcauuaagacuucaaaaauccuggagaugaccaauauagacgguaagagucaguuuguuagcuacgaaaugcagaggaaccucucucuggagaaugcaaaaacauccgugcuucuguugaacaaggucgaucuccugugggacgacuuauuccugauucuacaguuuguguggcacacuucaguagaacauuuccaaauccggaacguuaccuucgggggaaaggccuaucucgaucacaauagcuuugacuacaguaacacagugaugcgcaccauuaaacuggagcauguccacuuccgaguguuuuacauccagcaggauaagaucuaucuuuugcugacgaaaacugacauugaaaaucucacaauaucuaacgcucagaugccucacaugcuguucccaaauuaccccaccaaguuucaauaucuuaacuucgcaaauaacauccugacugaugaguuguuuaaaagaacacuccagcugccucauuuaaagacccugauucuaaauggcaacaaacucgagacgcugucccuugugagcugcuucgccaauaacaccccauuggaacaccuggaccucucgcagaaucuguuacaacauaagaacgaugagaauuguucuuggccggaaacagucguuaacaugaaccuguccuacaauaaacuuucagacaguguguuuaggugcuugcccaagagcauccagauacucgaucugaacaauaaccagauucagacuguaccuaaggagaccauccaccuaauggcucugcgggaacucaauaucgccuucaacuuucugacagaccuuccaggcuguucccauuucucucguuugagcgugcugaauauugagaugaacuuuaucuuaucacccagucucgauuucguccaauccugccaggaggugaaaacucugaaugcggggcgcaacccuuucagauguaccugcgaacuuaagaauuuuauucagcuggagacauauagcgaaguuaugauggugggauggucugacucauacaccugugaguauccauugaaccucagggguacucggcugaaagacguccaccuacacgaacugaguugcaauacggcacuccugauagugacaaucguaguuauuaugcuuguguugggccuggccgucgcuuucugcuguuuacauuuugaucuccccugguaccugcgaaugcuugggcagugcacccaaacuuggcaccgcgugagaaagaccacacaggagcagcugaagaggaacguccgguuccaugccuuuaucagcuacuccgagcacgacucucuaugggugaaaaaugaacucaucccgaaccuggagaaggaagauggaucgauuuugauaugucuguaugagagcuacuucgacccuggcaaauccaucucagagaacauuguuaguuuuaucgaaaagucuuauaaaagcauuuucguguuaucccccaauuuuguacagaacgaguggugccacuacgaguucuauuuugcacaucacaaucucuuccaugaaaacucagaucacaucauacugauccuucuggaaccaauuccuuuuuacuguauccccacccgcuaucauaaguugaaggcucuccuggagaaaaaggccuaccuagaguggccaaaagacagaaggaagugcggucuguucugggcgaaucuucgugccgcaauuaacgucaaugugcucgcuacucgggaaauguacgagcugcaaacauucacggaauugaacgaggaaagccgagggucuaccaucucccugaugagaacugauuguuuauga

SEQ ID NO: 9457 - RNA, 2436 nt, Artificial Sequence
  derived and/or modified sequence opt4 from TLR10__Homo_sapiens__AAY78478
augagacugaucagaaacaucuacaucuucugcagcaucgugaugaccgccgagggcgacgcccccgagcugcccgaggagagagagcugaugaccaacugcagcaacaugagccugagaaaggugcccgccgaccugacccccgccaccaccacccuggaccugagcuacaaccugcuguuccagcugcagagcagcgacuuccacagcgugagcaagcugagagugcugauccugugccacaacagaauccagcagcuggaccugaagaccuucgaguucaacaaggagcugagauaccuggaccugagcaacaacagacugaagagcgugaccugguaccugcuggccggccugagauaccuggaccugagcuucaacgacuucgacaccaugcccaucugcgaggaggccggcaacaugagccaccuggagauccugggccugagcggcgccaagauccagaagagcgacuuccagaagaucagccaccugcaccugaacaccguguuccugggcuucagaacccugccccacuacgaggagggcagccugcccauccugaacaccaccaagcugcacaucgugcugcccauggacaccaacuucugggugcugcugagagacggcaucaagaccagcaagauccuggagaugaccaacaucgacggcaagagccaguucgugagcuacgagaugcagagaaaccugagccuggagaacgccaagaccagcgugcugcugcugaacaagguggaccugcugugggacgaccuguuccugauccugcaguucguguggcacaccagcguggagcacuuccagaucagaaacgugaccuucggcggcaaggccuaccuggaccacaacagcuucgacuacagcaacaccgugaugagaaccaucaagcuggagcacgugcacuucagaguguucuacauccagcaggacaagaucuaccugcugcugaccaagaccgacaucgagaaccugaccaucagcaacgcccagaugccccacaugcuguuccccaacuaccccaccaaguuccaguaccugaacuucgccaacaacauccugaccgacgagcuguucaagagaacccugcagcugccccaccugaagacccugauccugaacggcaacaagcuggagacccugagccuggugagcugcuucgccaacaacaccccccuggagcaccuggaccugagccagaaccugcugcagcacaagaacgacgagaacugcagcuggcccgagaccguggugaacaugaaccugagcuacaacaagcugagcgacagcguguucagaugccugcccaagagcauccagauccuggaccugaacaacaaccagauccagaccgugcccaaggagaccauccaccugauggcccugagagagcugaacaucgccuucaacuuccugaccgaccugcccggcugcagccacuucagcagacugagcgugcugaacaucgagaugaacuucauccugagccccagccuggacuucgugcagagcugccaggaggugaagacccugaacgccggcagaaaccccuucagaugcaccugcgagcugaagaacuucauccagcuggagaccuacagcgaggugaugauggugggcuggagcgacagcuacaccugcgaguacccccugaaccugagaggcaccagacugaaggacgugcaccugcacgagcugagcugcaacaccgcccugcugaucgugaccaucguggugaucaugcuggugcugggccuggccguggccuucugcugccugcacuucgaccugcccugguaccugagaaugcugggccagugcacccagaccuggcacagagugagaaagaccacccaggagcagcugaagagaaacgugagauuccacgccuucaucagcuacagcgagcacgacagccugugggugaagaacgagcugauccccaaccuggagaaggaggacggcagcauccugaucugccuguacgagagcuacuucgaccccggcaagagcaucagcgagaacaucgugagcuucaucgagaagagcuacaagagcaucuucgugcugagccccaacuucgugcagaacgaguggugccacuacgaguucuacuucgcccaccacaaccuguuccacgagaacagcgaccacaucauccugauccugcuggagcccauccccuucuacugcauccccaccagauaccacaagcugaaggcccugcuggagaagaaggccuaccuggaguggcccaaggacagaagaaagugcggccuguucugggccaaccugagagccgccaucaacgugaacgugcuggccaccagagagauguacgagcugcagaccuucaccgagcugaacgaggagagcagaggcagcaccaucagccugaugagaaccgacugccuguga

SEQ ID NO: 9458 - RNA, 2436 nt, Artificial Sequence
  derived and/or modified sequence opt5 from TLR10__Homo_sapiens__AAY78478
augagacugauccggaacauuuacaucuucugcagcauugugaugaccgccgagggcgacgcucccgaacucccugaggaacgcgagcugaugacaaauuguuccaacaugucucuuagaaaggucccggccgaucugacgcccgcgaccacaacccucgaccugagcuauaaucuucuguuucagcuccaauccucugauuuccacagcguuuccaaacugcgggugcugauccucugccauaaccgcauucagcagcuggaccuuaagacauuugaguucaauaaagaacugagauaccucgaucugucuaacaaucggcuuaagagcgugaccugguaucugcucgcugggcugcgcuaccuggaccucuccuuuaacgauuucgacacaaugccuaucugugaggaagccggaaauaugagccaccuggagauccuuggccugucuggggccaaaauucagaaguccgauuuucaaaagaucagccaucuccaccugaacaccgucuuccuuggauuuagaacgcugccccauuaugaagagggcucucucccuauucugaauaccacaaaacugcacaucgugcuccccauggacaccaacuucuggguucugcuucgggaugggauuaagacauccaaaauccuggagaugaccaauauugacggaaagagccaguuugugucuuacgaaaugcagcgcaaccucucccuggagaaugcuaaaacgagcguccuucugcucaacaagguggaucugcugugggacgaccucuuccugauccuucaguuuguuuggcacacauccguggaacauuuccaaaucagaaacgucaccuucggcggcaaggccuaucuggaucacaauucuuuugacuacagcaacacagugaugcggaccauuaaacucgagcaugugcacuuccgcgucuuuuacauccagcaggauaagauuuaucugcugcuuaccaaaacagacaucgaaaaucucacgauuuccaacgcucagaugccucacaugcuguucccgaauuaccccaccaaguuucaauaucugaacuucgccaauaacauccucacagaugagcuguuuaaaagaacccuucagcugccucaucucaagacacugauccugaaugggaacaaacuugagacccucagccugguuucuugcuucgcgaauaacacgccccuggaacaccucgaccugucccagaaucuucugcaacauaagaacgaugagaauuguagcuggccugaaacaguggugaacaugaaccucucuuacaauaagcugagcgacuccgucuuucggugccugcccaaaucuauucagauccuugaucucaacaauaaccagauucagaccgugccgaaggagaccauccaccugauggcccugcgcgaacucaauauugcuuucaacuuucugacagaccuuccuggauguagccauuucuccagacugagcguucucaauaucgagaugaacuuuauccugucucccucccuggauuucgugcaaagcugccaggaggucaaaacccuuaaugccggccggaacccuuucagauguacaugcgaacucaagaauuuuauucagcuggagacguauucugaagugaugaugguugggugguccgacagcuacaccugugaguauccccugaaccuccgcggaacacggcugaaagacgugcaccuucacgaacuguccugcaauaccgcucuccugaucgucacaauuguggucaucaugcuggugcuuggccuggccguugcguucugcugucuccauuuugaucugcccugguaccucagaaugcuggggcagugcacccaaacguggcaccgcgugcggaagaccacacaggagcagcuuaagagaaacguccgcuuccaugccuuuauuucuuacagcgagcacgacucccugugggugaaaaaugaacucaucccuaaccuggagaaggaagauggaucuauucugaucugucuuuaugagagcuacuucgacccgggcaaauccaucagcgagaacauuguuucuuuuaucgaaaaguccuauaaaagcauuuucgugcugucucccaauuuuguccagaacgaguggugccacuacgaguucuauuuugcucaucacaaucucuuccaugaaaacuccgaucacaucauucugauccuccuggaaccuauccccuuuuacuguauuccuacccgguaucauaaacuuaaggcccugcucgagaagaaggcuuaccuggaguggcccaaagacagacgcaagugcggccuguucugggccaaucuucgggccgcuaucaacgugaaugugcuggcgacaagagaaauguacgagcuccaaaccuucacggaacugaacgaggaaagccgcgggucuacaauuagccucaugcggaccgauugucuguga

SEQ ID NO: 9459 - protein, 811 aa, Artificial Sequence [sequence omitted]

SEQ ID NO: 9460 - RNA, 2436 nt, Artificial Sequence
  TLR10__Homo_sapiens__AAY78482
augagacucaucagaaacauuuacauauuuuguaguauuguuaugacagcagagggugaugcuccagagcugccagaagaaagggaacugaugaccaacugcuccaacaugucucuaagaaagguucccgcagacuugaccccagccacaacgacacuggauuuauccuauaaccuccuuuuucaacuccagaguucagauuuucauucugucuccaaacugagaguuuugauucuaugccauaacagaauucaacagcuggaucucaaaaccuuugaauucaacaaggaguuaagauauuuagauuugucuaauaacagacugaagaguguaacuugguauuuacuggcaggucucagguauuuagaucuuucuuuuaaugacuuugacaccaugccuaucugugaggaagcuggcaacaugucacaccuggaaauccuagguuugaguggggcaaaaauacaaaaaucagauuuccagaaaauugcucaucugcaucuaaauacugucuucuuaggauucagaacucuuccucauuaugaagaagguagccugcccaucuuaaacacaacaaaacugcacauuguuuuaccaauggacacaaauuucuggguucuuuugcgugauggaaucaagacuucaaaaauauuagaaaugacaaauauagauggcaaaagccaauuuguaaguuaugaaaugcaacgaaaucuuaguuuagaacaugcuaagacaucgguucuauugcuuaauaaaguugauuuacucugggacgaccuuuuccuuaucuuacaauuuguuuggcauacaucaguggaacacuuucagauccgaaaugugacuuuuggugguaaggcuuaucuugaccacaauucauuugacuacucaaauacuguaaugagaacuauaaaauuggagcauguacauuucagaguguuuuacauucaacaggauaaaaucuauuugcuuuugaccaaaauggacauagaaaaccugacaauaucaaaugcacaaaugccacacaugcuuuucccuaauuauccuacgaaauuccaauauuuaaauuuugccaauaauaucuuaacagacgaguuguuuaaaagaacucuccaacugccucacuugaaaacucucauuuugaauggcaauaaacuggagacacuuucuuuaguaaguugcuuugcuaacaacacacccuuggaacacuuggaucugagucaaaaucuauuacaacauaaaaaugaugaaaauugcucauggccagaaacuguggucaauaugaaucugucauacaauaaauugucugauucugucuucaggugcuugcccaaaaguauucaaauacuugaccuaaauaauaaccaaauccaaacuguaccuaaagagacuauucaucugauggccuuacgagaacuaaauauugcauuuaauuuucuaacugaucucccuggaugcagucauuucaguagacuuucaguucugaacauugaaaugaacuucauucucagcccaucucuggauuuuguucagagcugccaggaaguuaaaacucuaaaugcgggaagaaauccauuccgguguaccugugaauuaaaaaauuucauucagcuugaaacauauucagaggucaugaugguuggauggucagauucauacaccugugaauacccuuuaaaccuaaggggaacuagguuaaaagacguucaucuccacgaauuaucuugcaacacagcucuguugauugucaccauugugguuauuaugcuaguucugggguuggcuguggccuucugcugucuccacuuugaucugcccugguaucucaggaugcuaggucaaugcacacaaacauggcacaggguuaggaaaacaacccaagaacaacucaagagaaauguccgauuccacgcauuuauuucauacagugaacaugauucucugugggugaagaaugaauugauccccaaucuagagaaggaagaugguucuaucuugauuugccuuuaugaaagcuacuuugacccuggcaaaagcauuagugaaaauauuguaagcuucauugagaaaagcuauaaguccaucuuuguuuugucucccaacuuuguccagaaugaguggugccauuaugaauucuacuuugcccaccacaaucucuuccaugaaaauucugaucacauaauucuuaucuuacuggaacccauuccauucuauugcauucccaccagguaucauaaacugaaagcucuccuggaaaaaaaagcauacuuggaauggcccaaggauaggcguaaaugugggcuuuucugggcaaaccuucgagcugcuguuaauguuaauguauuagccaccagagaaauguaugaacugcagacauucacagaguuaaaugaagagucucgagguucuacaaucucucugaugagaacagauugucuauaa

SEQ ID NO: 9461 - RNA, 2436 nt, Artificial Sequence
  derived and/or modified sequence opt1 from TLR10__Homo_sapiens__AAY78482
augcgccugauccggaacaucuacaucuucugcagcaucgugaugaccgccgagggcgacgcccccgagcucccggaggagcgcgagcugaugaccaacugcuccaacaugagccugcggaagguccccgcggaccucacgcccgccaccaccacccuggaccuguccuacaaccuccuguuccagcugcagagcuccgacuuccacagcguguccaagcuccgcgugcugauccugugccacaaccggauccagcagcucgaccugaagacguucgaguucaacaaggagcugcgcuaccucgaccugagcaacaaccggcugaaguccgucaccugguaccuccuggccgggcugcgcuaccucgaccugagcuucaacgacuucgacaccaugcccaucugcgaggaggccggcaacaugucccaccuggagauccucgggcugagcggcgccaagauccagaaguccgacuuccagaagaucgcgcaccuccaccugaacaccguguuccugggguuccggacgcugccgcacuacgaggagggcagccuccccauccugaacaccaccaagcugcacaucgugcuccccauggacaccaacuucuggguccugcugcgcgacggcaucaagacguccaagauccucgagaugaccaacaucgacgggaagucccaguucgugagcuacgagaugcagcggaaccugagccuggagcacgccaagaccuccgugcuccugcugaacaaggucgaccuccugugggacgaccuguuccucauccugcaguucguguggcacaccagcguggagcacuuccagauccgcaacgucacguucggcgggaaggccuaccuggaccacaacagcuucgacuacuccaacaccgugaugcggaccaucaagcucgagcacgugcacuuccgcgucuucuacauccagcaggacaagaucuaccugcugcugaccaagauggacaucgagaaccucacgaucagcaacgcccagaugccccacaugcuguucccgaacuaccccaccaaguuccaguaccugaacuucgcgaacaacauccucaccgacgagcuguucaagcggacccugcagcucccccaccugaagacgcugauccucaacggcaacaagcuggagacccugucccucgugagcugcuucgccaacaacacgccccuggagcaccuggaccucucccagaaccugcugcagcacaagaacgacgagaacugcagcuggccggagaccguggucaacaugaaccucuccuacaacaagcugagcgacuccguguuccgcugccugcccaagagcauccagauccucgaccugaacaacaaccagauccagaccgugcccaaggagaccauccaccugauggcccuccgggagcugaacaucgccuucaacuuccugaccgaccuccccgggugcucccacuucagccgccuguccguccugaacaucgagaugaacuucauccucagcccgucccuggacuucgugcagagcugccaggaggugaagacccugaacgccggccggaaccccuuccgcugcacgugcgagcucaagaacuucauccagcuggagaccuacuccgaggucaugauggugggcuggagcgacuccuacacgugcgaguacccccugaaccuccgggggacccgccugaaggacguccaccuccacgagcugagcugcaacaccgcgcugcugaucgugaccaucguggucaucaugcucgugcugggccuggccguggccuucugcugccuccacuucgaccugcccugguaccugcgcaugcucgggcagugcacccagaccuggcaccggguccgcaagaccacgcaggagcagcugaagcggaacgugcgcuuccacgccuucaucagcuacuccgagcacgacagccugugggugaagaacgagcucaucccgaaccuggagaaggaggacggcuccauccugaucugccucuacgagagcuacuucgaccccggcaaguccaucagcgagaacaucgucuccuucaucgagaaguccuacaagagcaucuucgugcugagccccaacuucgugcagaacgaguggugccacuacgaguucuacuucgcccaccacaaccuguuccacgagaacuccgaccacaucauccucauccugcuggagcccaucccguucuacugcauccccacccgguaccacaagcucaaggcgcugcuggagaagaaggccuaccucgaguggcccaaggaccgccggaagugcgggcuguucugggccaaccugcgcgccgccgucaacgugaacgugcucgcgacccgggagauguacgagcugcagaccuucacggagcugaacgaggagagccgcggcuccaccaucagccucaugcggaccgacugccuguga

SEQ ID NO: 9462 - RNA, 2436 nt, Artificial Sequence
  derived and/or modified sequence opt2 from TLR10__Homo_sapiens__AAY78482
augcgccucauccgcaacaucuacaucuucugcuccaucgucaugaccgccgagggcgacgcccccgagcuccccgaggagcgcgagcucaugaccaacugcuccaacaugucccuccgcaagguccccgccgaccucacccccgccaccaccacccucgaccucuccuacaaccuccucuuccagcuccaguccuccgacuuccacuccgucuccaagcuccgcguccucauccucugccacaaccgcauccagcagcucgaccucaagaccuucgaguucaacaaggagcuccgcuaccucgaccucuccaacaaccgccucaaguccgucaccugguaccuccucgccggccuccgcuaccucgaccucuccuucaacgacuucgacaccaugcccaucugcgaggaggccggcaacaugucccaccucgagauccucggccucuccggcgccaagauccagaaguccgacuuccagaagaucgcccaccuccaccucaacaccgucuuccucggcuuccgcacccucccccacuacgaggagggcucccuccccauccucaacaccaccaagcuccacaucguccuccccauggacaccaacuucuggguccuccuccgcgacggcaucaagaccuccaagauccucgagaugaccaacaucgacggcaagucccaguucgucuccuacgagaugcagcgcaaccucucccucgagcacgccaagaccuccguccuccuccucaacaaggucgaccuccucugggacgaccucuuccucauccuccaguucgucuggcacaccuccgucgagcacuuccagauccgcaacgucaccuucggcggcaaggccuaccucgaccacaacuccuucgacuacuccaacaccgucaugcgcaccaucaagcucgagcacguccacuuccgcgucuucuacauccagcaggacaagaucuaccuccuccucaccaagauggacaucgagaaccucaccaucuccaacgcccagaugccccacaugcucuuccccaacuaccccaccaaguuccaguaccucaacuucgccaacaacauccucaccgacgagcucuucaagcgcacccuccagcucccccaccucaagacccucauccucaacggcaacaagcucgagacccucucccucgucuccugcuucgccaacaacaccccccucgagcaccucgaccucucccagaaccuccuccagcacaagaacgacgagaacugcuccuggcccgagaccgucgucaacaugaaccucuccuacaacaagcucuccgacuccgucuuccgcugccuccccaaguccauccagauccucgaccucaacaacaaccagauccagaccguccccaaggagaccauccaccucauggcccuccgcgagcucaacaucgccuucaacuuccucaccgaccuccccggcugcucccacuucucccgccucuccguccucaacaucgagaugaacuucauccucucccccucccucgacuucguccaguccugccaggaggucaagacccucaacgccggccgcaaccccuuccgcugcaccugcgagcucaagaacuucauccagcucgagaccuacuccgaggucaugauggucggcugguccgacuccuacaccugcgaguacccccucaaccuccgcggcacccgccucaaggacguccaccuccacgagcucuccugcaacaccgcccuccucaucgucaccaucgucgucaucaugcucguccucggccucgccgucgccuucugcugccuccacuucgaccuccccugguaccuccgcaugcucggccagugcacccagaccuggcaccgcguccgcaagaccacccaggagcagcucaagcgcaacguccgcuuccacgccuucaucuccuacuccgagcacgacucccucugggucaagaacgagcucauccccaaccucgagaaggaggacggcuccauccucaucugccucuacgaguccuacuucgaccccggcaaguccaucuccgagaacaucgucuccuucaucgagaaguccuacaaguccaucuucguccucucccccaacuucguccagaacgaguggugccacuacgaguucuacuucgcccaccacaaccucuuccacgagaacuccgaccacaucauccucauccuccucgagcccauccccuucuacugcauccccacccgcuaccacaagcucaaggcccuccucgagaagaaggccuaccucgaguggcccaaggaccgccgcaagugcggccucuucugggccaaccuccgcgccgccgucaacgucaacguccucgccacccgcgagauguacgagcuccagaccuucaccgagcucaacgaggagucccgcggcuccaccaucucccucaugcgcaccgacugccucuga

SEQ ID NO: 9463 - RNA, 2436 nt, Artificial Sequence
  derived and/or modified sequence opt3 from TLR10__Homo_sapiens__AAY78482
augagacugaucaggaacauuuacauauucugcagcaucgugaugaccgccgagggcgacgcucccgaacucccugaggaacgggagcuuaugacaaauuguuccaacaugucucugcgcaaggucccagcagauuugacuccggccacgaccacauuagaccugucauauaaucuacucuuucagcugcaaaguagcgauuuccacuccguuucuaaacuucgagugcugauuuugugccauaaccguauccagcagcucgaccugaagacuuuugaauuuaauaaagagcugagauaccucgauuuaucgaacaauaggcugaagucaguaaccugguaucuuuuggcggggcugcgguaccuagaccucagcuucaacgauuucgacacaaugcccauuugugaggaagcuggaaauaugagucaccuggagauccuuggucuguccggcgccaaaauacagaagucugauuuucaaaagaucgcacauuugcaccucaacaccguguuccugggguuucgcacuuuaccucauuaugaagagggaagccugccaauucucaauacaaccaaacuucacaucguccugcccauggacacgaacuucuggguguugcuaagagauggcauuaagacuuccaaaauccuggagaugaccaauauagacgguaagucacaguuuguuaguuacgaaaugcagaggaaccucagccuggagcacgccaaaacaucugugcuucuguugaauaaggucgaucuccugugggacgacuuauuccugauucuacaguuuguguggcauacuuccguagaacacuuccaaauccggaacguuaccuucgggggaaaggcuuaucucgaucauaacucauuugacuacagcaauacagugaugcgcaccauuaaacuggagcacguccacuuccgaguguuuuacauccagcaggauaagaucuaucuuuugcugacgaaaauggacauugaaaaccucacuauaaguaaugcacagaugccucauaugcuguucccaaacuaccccacaaaguuucaauaucuuaauuucgccaacaauauccugaccgaugaguuguuuaaaagaacucuccagcugccucacuuaaagacacugauucuaaacggcaauaaacucgagacccugucucuuguguccugcuucgcuaacaauacgccauuggaacaucuggaccucagccagaaccuguuacaacacaagaaugaugagaacuguucguggccggaaaccgucguuaauaugaaccugucuuacaacaaacuuuccgacucaguguuuaggugcuugcccaagaguauccagauacucgaucugaauaacaaucagauucagacaguaccuaaggagacuauccaucuaauggcccugcgggaacucaacaucgcguucaauuuucugaccgaccuuccaggcuguagccacuucucccguuugucugugcugaacauugagaugaauuuuaucuuaagccccucacucgauuucguccaaaguugccaggaggugaaaacacugaacgcagggcgcaauccuuucagauguacuugcgaacuuaagaacuuuauucagcuggagaccuauuccgaaguuaugauggugggauggagcgacucuuacacaugugaguauccauugaaucucagggguacccggcugaaagacguccaccuacaugaacugucaugcaacacugcccuccugauagugacgaucguaguuauuaugcuuguguugggccuggcugucgccuucugcuguuuacacuuugaucuccccugguaccugcgaaugcuugggcagugcacacaaaccuggcaucgcgugagaaagacuacccaggagcagcugaagaggaauguccgguuccacgcauuuaucaguuacagcgagcacgacucccuaugggugaaaaacgaacucaucccgaaucuggagaaggaagauggaucuauuuugauaugucuguaugagucguacuucgacccuggcaaaagcaucuccgagaacauuguuucauuuaucgaaaagaguuauaaaucuauuuucguguuaagccccaacuuuguacagaaugaguggugccauuacgaguucuauuuugcucaccauaaccucuuccacgaaaauuccgaucauaucauacugauccuucuggaaccaauuccuuuuuacuguauccccacacgcuaucacaaguugaaggcccuccuggagaaaaaggcguaccuagaguggccaaaagacagaaggaagugcggucuguucugggccaaccuucgugcagcugucaaugugaacguucucgccacccgggaaauguacgagcugcaaacuuucacagaauugaaugaggaaucacgagggagcacgauuucucugaugagaaccgauuguuuauga

SEQ ID NO: 9464 - RNA, 2436 nt, Artificial Sequence
  derived and/or modified sequence opt4 from TLR10__Homo_sapiens__AAY78482
augagacugaucagaaacaucuacaucuucugcagcaucgugaugaccgccgagggcgacgcccccgagcugcccgaggagagagagcugaugaccaacugcagcaacaugagccugagaaaggugcccgccgaccugacccccgccaccaccacccuggaccugagcuacaaccugcuguuccagcugcagagcagcgacuuccacagcgugagcaagcugagagugcugauccugugccacaacagaauccagcagcuggaccugaagaccuucgaguucaacaaggagcugagauaccuggaccugagcaacaacagacugaagagcgugaccugguaccugcuggccggccugagauaccuggaccugagcuucaacgacuucgacaccaugcccaucugcgaggaggccggcaacaugagccaccuggagauccugggccugagcggcgccaagauccagaagagcgacuuccagaagaucgcccaccugcaccugaacaccguguuccugggcuucagaacccugccccacuacgaggagggcagccugcccauccugaacaccaccaagcugcacaucgugcugcccauggacaccaacuucugggugcugcugagagacggcaucaagaccagcaagauccuggagaugaccaacaucgacggcaagagccaguucgugagcuacgagaugcagagaaaccugagccuggagcacgccaagaccagcgugcugcugcugaacaagguggaccugcugugggacgaccuguuccugauccugcaguucguguggcacaccagcguggagcacuuccagaucagaaacgugaccuucggcggcaaggccuaccuggaccacaacagcuucgacuacagcaacaccgugaugagaaccaucaagcuggagcacgugcacuucagaguguucuacauccagcaggacaagaucuaccugcugcugaccaagauggacaucgagaaccugaccaucagcaacgcccagaugccccacaugcuguuccccaacuaccccaccaaguuccaguaccugaacuucgccaacaacauccugaccgacgagcuguucaagagaacccugcagcugccccaccugaagacccugauccugaacggcaacaagcuggagacccugagccuggugagcugcuucgccaacaacaccccccuggagcaccuggaccugagccagaaccugcugcagcacaagaacgacgagaacugcagcuggcccgagaccguggugaacaugaaccugagcuacaacaagcugagcgacagcguguucagaugccugcccaagagcauccagauccuggaccugaacaacaaccagauccagaccgugcccaaggagaccauccaccugauggcccugagagagcugaacaucgccuucaacuuccugaccgaccugcccggcugcagccacuucagcagacugagcgugcugaacaucgagaugaacuucauccugagccccagccuggacuucgugcagagcugccaggaggugaagacccugaacgccggcagaaaccccuucagaugcaccugcgagcugaagaacuucauccagcuggagaccuacagcgaggugaugauggugggcuggagcgacagcuacaccugcgaguacccccugaaccugagaggcaccagacugaaggacgugcaccugcacgagcugagcugcaacaccgcccugcugaucgugaccaucguggugaucaugcuggugcugggccuggccguggccuucugcugccugcacuucgaccugcccugguaccugagaaugcugggccagugcacccagaccuggcacagagugagaaagaccacccaggagcagcugaagagaaacgugagauuccacgccuucaucagcuacagcgagcacgacagccugugggugaagaacgagcugauccccaaccuggagaaggaggacggcagcauccugaucugccuguacgagagcuacuucgaccccggcaagagcaucagcgagaacaucgugagcuucaucgagaagagcuacaagagcaucuucgugcugagccccaacuucgugcagaacgaguggugccacuacgaguucuacuucgcccaccacaaccuguuccacgagaacagcgaccacaucauccugauccugcuggagcccauccccuucuacugcauccccaccagauaccacaagcugaaggcccugcuggagaagaaggccuaccuggaguggcccaaggacagaagaaagugcggccuguucugggccaaccugagagccgccgugaacgugaacgugcuggccaccagagagauguacgagcugcagaccuucaccgagcugaacgaggagagcagaggcagcaccaucagccugaugagaaccgacugccuguga

SEQ ID NO: 9465 - RNA, 2436 nt, Artificial Sequence
  derived and/or modified sequence opt5 from TLR10__Homo_sapiens__AAY78482
augagacugauccggaacauuuacaucuucugcagcauugugaugaccgccgagggcgacgcucccgaacucccugaggaacgcgagcugaugacaaauuguuccaacaugucucuuagaaaggucccggccgaucugacgcccgcgaccacaacccucgaccugagcuauaaucuucuguuucagcuccaauccucugauuuccacagcguuuccaaacugcgggugcugauccucugccauaaccgcauucagcagcuggaccuuaagacauuugaguucaauaaagagcugagauaccucgaucugucuaacaaucggcuuaagagcgugaccugguaucugcucgcugggcugcgcuaccuggaccucuccuuuaacgauuucgacacaaugccuaucugugaggaagccggaaauaugagccaccuggagauccuuggccugucuggggccaaaauucagaaguccgauuuucaaaagaucgcucaucuccaccugaacaccgucuuccuuggauuuagaacgcugccccauuaugaagagggcagccucccuauucugaauaccacaaaacugcacaucgugcuccccauggacaccaacuucuggguucugcuucgggaugggauuaagacaucuaaaauccuggagaugaccaauauugacggaaagucccaguuugugagcuacgaaaugcagcgcaaccucucucuggagcacgccaaaacguccguccuucugcucaauaagguggaucugcugugggacgaccucuuccugauccuucaguuuguuuggcauacaagcguggaacacuuccaaaucagaaacgucaccuucggcggcaaggcuuaucuggaucauaacuccuuugacuacucuaauacagugaugcggaccauuaaacucgagcacgugcacuuccgcgucuuuuacauccagcaggauaagauuuaucugcugcuuaccaaaauggacaucgaaaaccucacaauuagcaaugcccagaugccucauaugcuguucccgaacuaccccacgaaguuucaauaucugaauuucgcgaacaauauccucaccgaugagcuguuuaaaagaacacuucagcugccucaccucaagacccugauccugaacgggaauaaacuugagacacucucccugguuagcugcuucgccaacaauacgccccuggaacaucucgaccugucucagaaccuucugcaacacaagaaugaugagaacuguuccuggccugaaaccguggugaauaugaaccucagcuacaacaagcugucugacagcgucuuucggugccugcccaaauccauucagauccuugaucucaauaacaaucagauucagacagugccgaaggagaccauccaucugauggcucugcgcgaacucaacauugccuucaauuuucugaccgaccuuccuggauguucucacuucagcagacuguccguucucaacaucgagaugaauuuuauccugagccccucucuggauuucgugcaauccugccaggaggucaaaacacuuaacgcuggccggaauccuuucagauguaccugcgaacucaagaacuuuauucagcuggagacauauagcgaagugaugaugguuggguggucugacuccuacacgugugaguauccccugaaucuccgcggaacccggcugaaagacgugcaccuucaugaacugagcugcaacacagcccuccugaucgucaccauuguggucaucaugcuggugcuuggccuggcgguugccuucugcugucuccacuuugaucugcccugguaccucagaaugcuggggcagugcacacaaaccuggcaucgcgugcggaagacgacccaggagcagcuuaagagaaauguccgcuuccacgcuuuuauuuccuacucugagcacgacagccugugggugaaaaacgaacucaucccuaaucuggagaaggaagauggauccauucugaucugucuuuaugagucuuacuucgacccgggcaaaagcaucuccgagaacauuguuagcuuuaucgaaaagucuuauaaauccauuuucgugcugagccccaacuuuguccagaaugaguggugccauuacgaguucuauuuugcccaccauaaccucuuccacgaaaauucugaucauaucauucugauccuccuggaaccuauccccuuuuacuguauuccuacacgguaucacaaacuuaaggcucugcucgaaaagaaggccuaccuggaguggcccaaagacagacgcaagugcggccuguucugggccaaccuucgggcugcggugaaugugaacguucuggccaccagagaaauguacgagcuccaaacauucaccgaacugaaugaggaaucccgcgggagcacgaucucucucaugcggacagauugucuguga

SEQ ID NO: 9466 - protein, 811 aa, Artificial Sequence [sequence omitted]

SEQ ID NO: 9467 - RNA, 2436 nt, Artificial Sequence
  TLR10__Homo_sapiens__AAY78484
augagacucaucagaaacauuuacauauuuuguaguauuguuaugacagcagagggugaugcuccagagcugccagaagaaagggaacugaugaccaacugcuccaacaugucucuaagaaagguucccgcagacuugaccccagccacaacgacacuggauuuauccuauaaccuccuuuuucaacuccagaguucagauuuucauucugucuccaaacugagaguuuugauucuaugccauaacagaauucaacagcuggaucucaaaaccuuugaauucaacaaggaguuaagauauuuagauuugucuaauaacagacugaagaguguaacuugguauuuacuggcaggucucagguauuuagaucuuucuuuuaaugacuuugacaccaugccuaucugugaggaagcuggcaacaugucacaccuggaaauccuagguuugaguggggcaaaaauacaaaaaucagauuuccagaaaauugcucaucugcaucuaaauacugucuucuuaggauucagaacucuuccucauuaugaagaagguagccugcccaucuuaaacacaacaaaacugcacauuguuuuaccaauggacacaaauuucuggguucuuuugcgugauggaaucaagacuucaaaaauauuagaaaugacaaauauagauggcaaaagccaauuuguaaguuaugaaaugcaacgaaaucuuaguuuagaacaugcuaagacaucgguucuauugcuuaauaaaguugauuuacucugggacgaccuuuuccuuaucuuacaauuuguuuggcauacaucaguggaacacuuucagauccgaaaugugacuuuuggugguaaggcuuaucuugaccacaauucauuugacuacucaaauacuguaaugagaacuauaaaauuggagcauguacauuucagaguguuuuacauucaacaggauaaaaucuauuugcuuuugaccaaaauggacauagaaaaccugacaauaucaaaugcacaaaugccacacaugcuuuucccuaauuauccuacgaaauuccaauauuuaaauuuugccaauaauaucuuaacagacgaguuguuuaaaagaacucuccaacugccucacuugaaaacucucauuuugaauggcaauaaacuggagacacuuucuuuaguaaguugcuuugcuaacaacacacccuuggaacacuuggaucugagucaaaaucuauuacaacauaaaaaugaugaaaauugcucauggccagaaacuguggucaauaugaaucugucauacaauaaauugucugauucugucuucaggugcuugcccaaaaguauucaaauacuugaccuaaauaauaaccaaauccaaacuguaccuaaagagacuauucaucugauggccuuacgagaacuaaauacugcauuuaauuuucuaacugaucucccuggaugcagucauuucaguagacuuucaguucugaacauugaaaugaacuucauucucagcccaucucuggauuuuguucagagcugccaggaaguuaaaacucuaaaugcgggaagaaauccauuccgguguaccugugaauuaaaaaauuucauucagcuugaaacauauucagaggucaugaugguuggauggucagauucauacaccugugaauacccuuuaaaccuaaggggaacuagguuaaaagacguucaucuccacgaauuaucuugcaacacagcucuguugauugucaccauugugguuauuaugcuaguucugggguuggcuguggccuucugcugucuccacuuugaucugcccugguaucucaggaugcuaggucaaugcacacaaacauggcacaggguuaggaaaacaacccaagaacaacucaagagaaauguccgauuccacgcauuuauuucauacagugaacaugauucucugugggugaagaaugaauugauccccaaucuagagaaggaagaugguucuaucuugauuugccuuuaugaaagcuacuuugacccuggcaaaagcauuagugaaaauauuguaagcuucauugagaaaagcuauaaguccaucuuuguuuugucucccaacuuuguccagaaugaguggugccauuaugaauucuacuuugcccaccacaaucucuuccaugaaaauucugaucacauaauucuuaucuuacuggaacccauuccauucuauugcauucccaccagguaucauaaacugaaagcucuccuggaaaaaaaagcauacuuggaauggcccaaggauaggcguaaaugugggcuuuucugggcaaaccuucgagcugcuguuaauguuaauguauuagccaccagagaaauguaugaacugcagacauucacagaguuaaaugaagagucucgagguucuacaaucucucugaugagaacagacugucuauaa

SEQ ID NO: 9468 - RNA, 2436 nt, Artificial Sequence
  derived and/or modified sequence opt1 from TLR10__Homo_sapiens__AAY78484
augcgccugauccggaacaucuacaucuucugcagcaucgugaugaccgccgagggcgacgcccccgagcucccggaggagcgcgagcugaugaccaacugcuccaacaugagccugcggaagguccccgcggaccucacgcccgccaccaccacccuggaccuguccuacaaccuccuguuccagcugcagagcuccgacuuccacagcguguccaagcuccgcgugcugauccugugccacaaccggauccagcagcucgaccugaagacguucgaguucaacaaggagcugcgcuaccucgaccugagcaacaaccggcugaaguccgucaccugguaccuccuggccgggcugcgcuaccucgaccugagcuucaacgacuucgacaccaugcccaucugcgaggaggccggcaacaugucccaccuggagauccucgggcugagcggcgccaagauccagaaguccgacuuccagaagaucgcgcaccuccaccugaacaccguguuccugggguuccggacgcugccgcacuacgaggagggcagccuccccauccugaacaccaccaagcugcacaucgugcuccccauggacaccaacuucuggguccugcugcgcgacggcaucaagacguccaagauccucgagaugaccaacaucgacgggaagucccaguucgugagcuacgagaugcagcggaaccugagccuggagcacgccaagaccuccgugcuccugcugaacaaggucgaccuccugugggacgaccuguuccucauccugcaguucguguggcacaccagcguggagcacuuccagauccgcaacgucacguucggcgggaaggccuaccuggaccacaacagcuucgacuacuccaacaccgugaugcggaccaucaagcucgagcacgugcacuuccgcgucuucuacauccagcaggacaagaucuaccugcugcugaccaagauggacaucgagaaccucacgaucagcaacgcccagaugccccacaugcuguucccgaacuaccccaccaaguuccaguaccugaacuucgcgaacaacauccucaccgacgagcuguucaagcggacccugcagcucccccaccugaagacgcugauccucaacggcaacaagcuggagacccugucccucgugagcugcuucgccaacaacacgccccuggagcaccuggaccucucccagaaccugcugcagcacaagaacgacgagaacugcagcuggccggagaccguggucaacaugaaccucuccuacaacaagcugagcgacuccguguuccgcugccugcccaagagcauccagauccucgaccugaacaacaaccagauccagaccgugcccaaggagaccauccaccugauggcccuccgggagcugaacaccgccuucaacuuccugaccgaccuccccgggugcucccacuucagccgccuguccguccugaacaucgagaugaacuucauccucagcccgucccuggacuucgugcagagcugccaggaggugaagacgcugaacgccggccggaaccccuuccgcugcacgugcgagcucaagaacuucauccagcuggagaccuacuccgaggucaugauggugggcuggagcgacuccuacacgugcgaguacccccugaaccuccgggggacccgccugaaggacguccaccuccacgagcugagcugcaacaccgcgcugcugaucgugaccaucguggucaucaugcucgugcugggccuggccguggccuucugcugccuccacuucgaccugcccugguaccugcgcaugcucgggcagugcacccagaccuggcaccggguccgcaagaccacccaggagcagcugaagcggaacgugcgcuuccacgccuucaucagcuacuccgagcacgacagccugugggugaagaacgagcucaucccgaaccuggagaaggaggacggcuccauccugaucugccucuacgagagcuacuucgaccccggcaaguccaucagcgagaacaucgucuccuucaucgagaaguccuacaagagcaucuucgugcugagccccaacuucgugcagaacgaguggugccacuacgaguucuacuucgcccaccacaaccuguuccacgagaacuccgaccacaucauccucauccugcuggagcccaucccguucuacugcauccccacccgguaccacaagcucaaggcgcugcuggagaagaaggccuaccucgaguggcccaaggaccgccggaagugcgggcuguucugggccaaccugcgcgccgccgucaacgugaacgugcucgcgacccgggagauguacgagcugcagacguucaccgagcugaacgaggagagccgcggcuccaccaucagccucaugcggaccgacugccuguga

SEQ ID NO: 9469 - RNA, 2436 nt, Artificial Sequence
  derived and/or modified sequence opt2 from TLR10__Homo_sapiens__AAY78484
augcgccucauccgcaacaucuacaucuucugcuccaucgucaugaccgccgagggcgacgcccccgagcuccccgaggagcgcgagcucaugaccaacugcuccaacaugucccuccgcaagguccccgccgaccucacccccgccaccaccacccucgaccucuccuacaaccuccucuuccagcuccaguccuccgacuuccacuccgucuccaagcuccgcguccucauccucugccacaaccgcauccagcagcucgaccucaagaccuucgaguucaacaaggagcuccgcuaccucgaccucuccaacaaccgccucaaguccgucaccugguaccuccucgccggccuccgcuaccucgaccucuccuucaacgacuucgacaccaugcccaucugcgaggaggccggcaacaugucccaccucgagauccucggccucuccggcgccaagauccagaaguccgacuuccagaagaucgcccaccuccaccucaacaccgucuuccucggcuuccgcacccucccccacuacgaggagggcucccuccccauccucaacaccaccaagcuccacaucguccuccccauggacaccaacuucuggguccuccuccgcgacggcaucaagaccuccaagauccucgagaugaccaacaucgacggcaagucccaguucgucuccuacgagaugcagcgcaaccucucccucgagcacgccaagaccuccguccuccuccucaacaaggucgaccuccucugggacgaccucuuccucauccuccaguucgucuggcacaccuccgucgagcacuuccagauccgcaacgucaccuucggcggcaaggccuaccucgaccacaacuccuucgacuacuccaacaccgucaugcgcaccaucaagcucgagcacguccacuuccgcgucuucuacauccagcaggacaagaucuaccuccuccucaccaagauggacaucgagaaccucaccaucuccaacgcccagaugccccacaugcucuuccccaacuaccccaccaaguuccaguaccucaacuucgccaacaacauccucaccgacgagcucuucaagcgcacccuccagcucccccaccucaagacccucauccucaacggcaacaagcucgagacccucucccucgucuccugcuucgccaacaacaccccccucgagcaccucgaccucucccagaaccuccuccagcacaagaacgacgagaacugcuccuggcccgagaccgucgucaacaugaaccucuccuacaacaagcucuccgacuccgucuuccgcugccuccccaaguccauccagauccucgaccucaacaacaaccagauccagaccguccccaaggagaccauccaccucauggcccuccgcgagcucaacaccgccuucaacuuccucaccgaccuccccggcugcucccacuucucccgccucuccguccucaacaucgagaugaacuucauccucucccccucccucgacuucguccaguccugccaggaggucaagacccucaacgccggccgcaaccccuuccgcugcaccugcgagcucaagaacuucauccagcucgagaccuacuccgaggucaugauggucggcugguccgacuccuacaccugcgaguacccccucaaccuccgcggcacccgccucaaggacguccaccuccacgagcucuccugcaacaccgcccuccucaucgucaccaucgucgucaucaugcucguccucggccucgccgucgccuucugcugccuccacuucgaccuccccugguaccuccgcaugcucggccagugcacccagaccuggcaccgcguccgcaagaccacccaggagcagcucaagcgcaacguccgcuuccacgccuucaucuccuacuccgagcacgacucccucugggucaagaacgagcucauccccaaccucgagaaggaggacggcuccauccucaucugccucuacgaguccuacuucgaccccggcaaguccaucuccgagaacaucgucuccuucaucgagaaguccuacaaguccaucuucguccucucccccaacuucguccagaacgaguggugccacuacgaguucuacuucgcccaccacaaccucuuccacgagaacuccgaccacaucauccucauccuccucgagcccauccccuucuacugcauccccacccgcuaccacaagcucaaggcccuccucgagaagaaggccuaccucgaguggcccaaggaccgccgcaagugcggccucuucugggccaaccuccgcgccgccgucaacgucaacguccucgccacccgcgagauguacgagcuccagaccuucaccgagcucaacgaggagucccgcggcuccaccaucucccucaugcgcaccgacugccucuga

SEQ ID NO: 9470 - RNA, 2436 nt, Artificial Sequence
  derived and/or modified sequence opt3 from TLR10__Homo_sapiens__AAY78484
augagacugaucaggaacauuuacauauucugcagcaucgugaugaccgccgagggcgacgcucccgaacucccugaggaacgggagcuuaugacaaauuguuccaacaugucucugcgcaaggucccagcagauuugacuccggccacgaccacauuagaccugucauauaaucuacucuuucagcugcaaaguagcgauuuccacuccguuucuaaacuucgagugcugauuuugugccauaaccguauccagcagcucgaccugaagacuuuugaauuuaauaaagagcugagauaccucgauuuaucgaacaauaggcugaagucaguaaccugguaucuuuuggcggggcugcgguaccuagaccucagcuucaacgauuucgacacaaugcccauuugugaggaagcuggaaauaugagucaccuggagauccuuggucuguccggcgccaaaauacagaagucugauuuucaaaagaucgcacauuugcaccucaacaccguguuccugggguuucgcacuuuaccucauuaugaagagggaagccugccaauucucaauacaaccaaacuucacaucguccugcccauggacacgaacuucuggguguugcuaagagauggcauuaagacuuccaaaauccuggagaugaccaauauagacgguaagucacaguuuguuaguuacgaaaugcagaggaaccucagccuggagcacgccaaaacaucugugcuucuguugaauaaggucgaucuccugugggacgacuuauuccugauucuacaguuuguguggcauacuuccguagaacacuuccaaauccggaacguuaccuucgggggaaaggcuuaucucgaucauaacucauuugacuacagcaauacagugaugcgcaccauuaaacuggagcacguccacuuccgaguguuuuacauccagcaggauaagaucuaucuuuugcugacgaaaauggacauugaaaaccucacuauaaguaaugcacagaugccucauaugcuguucccaaacuaccccacaaaguuucaauaucuuaauuucgccaacaauauccugaccgaugaguuguuuaaaagaacucuccagcugccucacuuaaagacacugauucuaaacggcaauaaacucgagacccugucucuuguguccugcuucgcuaacaauacgccauuggaacaucuggaccucagccagaaccuguuacaacacaagaaugaugagaacuguucguggccggaaaccgucguuaauaugaaccugucuuacaacaaacuuuccgacucaguguuuaggugcuugcccaagaguauccagauacucgaucugaauaacaaucagauucagacaguaccuaaggagacuauccaucuaauggcccugcgggaacucaacaccgcguucaauuuucugacagaccuuccaggcuguagccacuucucccguuugucugugcugaacaucgagaugaauuuuauuuuaagccccucacucgauuucguccaaaguugccaggaggugaaaacucugaacgcagggcgcaauccuuucagauguaccugcgaacuuaagaacuuuauccagcuggagacauauuccgaaguuaugauggugggauggagcgacucuuacaccugugaguauccauugaaucucagggguacucggcugaaagacguccaccuacaugaacugucaugcaacacggcccuccugauugugacaauaguaguuaucaugcuuguguugggccuggcugucgccuucugcuguuuacacuuugaucuccccugguaccugcgaaugcuugggcagugcacccaaacuuggcaucgcgugagaaagaccacacaggagcagcugaagaggaauguccgguuccacgcauuuauuaguuacagcgagcacgacucccuaugggugaaaaacgaacucaucccgaaucuggagaaggaagauggaucuaucuugauuugucuguaugagucguacuucgacccuggcaaaagcauauccgagaacaucguuucauuuauugaaaagaguuauaaaucuaucuucguguuaagccccaacuuuguacagaaugaguggugccauuacgaguucuauuuugcucaccauaaccucuuccacgaaaauuccgaucauauuauccugauacuucuggaaccaaucccuuuuuacuguauucccacccgcuaucacaaguugaaggcccuccuggagaaaaaggcguaccuagaguggccaaaagacagaaggaagugcggucuguucugggccaaccuucgugcagcugucaaugugaacguucucgccacucgggaaauguacgagcugcaaacauucacggaauugaaugaggaaucacgagggagcaccaucucucugaugagaacugauuguuuauga

SEQ ID NO: 9471 - RNA, 2436 nt, Artificial Sequence
  derived and/or modified sequence opt4 from TLR10__Homo_sapiens__AAY78484
augagacugaucagaaacaucuacaucuucugcagcaucgugaugaccgccgagggcgacgcccccgagcugcccgaggagagagagcugaugaccaacugcagcaacaugagccugagaaaggugcccgccgaccugacccccgccaccaccacccuggaccugagcuacaaccugcuguuccagcugcagagcagcgacuuccacagcgugagcaagcugagagugcugauccugugccacaacagaauccagcagcuggaccugaagaccuucgaguucaacaaggagcugagauaccuggaccugagcaacaacagacugaagagcgugaccugguaccugcuggccggccugagauaccuggaccugagcuucaacgacuucgacaccaugcccaucugcgaggaggccggcaacaugagccaccuggagauccugggccugagcggcgccaagauccagaagagcgacuuccagaagaucgcccaccugcaccugaacaccguguuccugggcuucagaacccugccccacuacgaggagggcagccugcccauccugaacaccaccaagcugcacaucgugcugcccauggacaccaacuucugggugcugcugagagacggcaucaagaccagcaagauccuggagaugaccaacaucgacggcaagagccaguucgugagcuacgagaugcagagaaaccugagccuggagcacgccaagaccagcgugcugcugcugaacaagguggaccugcugugggacgaccuguuccugauccugcaguucguguggcacaccagcguggagcacuuccagaucagaaacgugaccuucggcggcaaggccuaccuggaccacaacagcuucgacuacagcaacaccgugaugagaaccaucaagcuggagcacgugcacuucagaguguucuacauccagcaggacaagaucuaccugcugcugaccaagauggacaucgagaaccugaccaucagcaacgcccagaugccccacaugcuguuccccaacuaccccaccaaguuccaguaccugaacuucgccaacaacauccugaccgacgagcuguucaagagaacccugcagcugccccaccugaagacccugauccugaacggcaacaagcuggagacccugagccuggugagcugcuucgccaacaacaccccccuggagcaccuggaccugagccagaaccugcugcagcacaagaacgacgagaacugcagcuggcccgagaccguggugaacaugaaccugagcuacaacaagcugagcgacagcguguucagaugccugcccaagagcauccagauccuggaccugaacaacaaccagauccagaccgugcccaaggagaccauccaccugauggcccugagagagcugaacaccgccuucaacuuccugaccgaccugcccggcugcagccacuucagcagacugagcgugcugaacaucgagaugaacuucauccugagccccagccuggacuucgugcagagcugccaggaggugaagacccugaacgccggcagaaaccccuucagaugcaccugcgagcugaagaacuucauccagcuggagaccuacagcgaggugaugauggugggcuggagcgacagcuacaccugcgaguacccccugaaccugagaggcaccagacugaaggacgugcaccugcacgagcugagcugcaacaccgcccugcugaucgugaccaucguggugaucaugcuggugcugggccuggccguggccuucugcugccugcacuucgaccugcccugguaccugagaaugcugggccagugcacccagaccuggcacagagugagaaagaccacccaggagcagcugaagagaaacgugagauuccacgccuucaucagcuacagcgagcacgacagccugugggugaagaacgagcugauccccaaccuggagaaggaggacggcagcauccugaucugccuguacgagagcuacuucgaccccggcaagagcaucagcgagaacaucgugagcuucaucgagaagagcuacaagagcaucuucgugcugagccccaacuucgugcagaacgaguggugccacuacgaguucuacuucgcccaccacaaccuguuccacgagaacagcgaccacaucauccugauccugcuggagcccauccccuucuacugcauccccaccagauaccacaagcugaaggcccugcuggagaagaaggccuaccuggaguggcccaaggacagaagaaagugcggccuguucugggccaaccugagagccgccgugaacgugaacgugcuggccaccagagagauguacgagcugcagaccuucaccgagcugaacgaggagagcagaggcagcaccaucagccugaugagaaccgacugccuguga

SEQ ID NO: 9472 - RNA, 2436 nt, Artificial Sequence
  derived and/or modified sequence opt5 from TLR10__Homo_sapiens__AAY78484
augagacugauccggaacauuuacaucuucugcagcauugugaugaccgccgagggcgacgcucccgaacucccugaggaacgcgagcugaugacaaauuguuccaacaugucucuuagaaaggucccggccgaucugacgcccgcgaccacaacccucgaccugagcuauaaucuucuguuucagcuccaauccucugauuuccacagcguuuccaaacugcgggugcugauccucugccauaaccgcauucagcagcuggaccuuaagacauuugaguucaauaaagagcugagauaccucgaucugucuaacaaucggcuuaagagcgugaccugguaucugcucgcugggcugcgcuaccuggaccucuccuuuaacgauuucgacacaaugccuaucugugaggaagccggaaauaugagccaccuggagauccuuggccugucuggggccaaaauucagaaguccgauuuucaaaagaucgcucaucuccaccugaacaccgucuuccuuggauuuagaacgcugccccauuaugaagagggcagccucccuauucugaauaccacaaaacugcacaucgugcuccccauggacaccaacuucuggguucugcuucgggaugggauuaagacaucuaaaauccuggagaugaccaauauugacggaaagucccaguuugugagcuacgaaaugcagcgcaaccucucucuggagcacgccaaaacguccguccuucugcucaauaagguggaucugcugugggacgaccucuuccugauccuucaguuuguuuggcauacaagcguggaacacuuccaaaucagaaacgucaccuucggcggcaaggcuuaucuggaucauaacuccuuugacuacucuaauacagugaugcggaccauuaaacucgagcacgugcacuuccgcgucuuuuacauccagcaggauaagauuuaucugcugcuuaccaaaauggacaucgaaaaccucacaauuagcaaugcccagaugccucauaugcuguucccgaacuaccccacgaaguuucaauaucugaauuucgcgaacaauauccucaccgaugagcuguuuaaaagaacacuucagcugccucaccucaagacccugauccugaacgggaauaaacuugagacacucucccugguuagcugcuucgccaacaauacgccccuggaacaucucgaccugucucagaaccuucugcaacacaagaaugaugagaacuguuccuggccugaaaccguggugaauaugaaccucagcuacaacaagcugucugacagcgucuuucggugccugcccaaauccauucagauccuugaucucaauaacaaucagauucagacagugccgaaggagaccauccaucugauggcucugcgcgaacucaacaccgccuucaauuuucugacagaccuuccuggauguucucacuucagcagacuguccguucucaacauugagaugaauuuuauccugagccccucucuggauuucgugcaauccugccaggaggucaaaacccuuaacgcuggccggaauccuuucagauguacaugcgaacucaagaacuuuauccagcuggagacguauagcgaagugaugaugguuggguggucugacuccuacaccugugaguauccccugaaucuccgcggaacacggcugaaagacgugcaccuucaugaacugagcugcaacaccgcccuccugauugucacaaucguggucauuaugcuggugcuuggccuggcgguugccuucugcugucuccacuuugaucugcccugguaccucagaaugcuggggcagugcacccaaacguggcaucgcgugcggaagaccacacaggagcagcuuaagagaaauguccgcuuccacgcuuuuaucuccuacucugagcacgacagccugugggugaaaaacgaacucauuccuaaucuggagaaggaagauggauccauccugauuugucuuuaugagucuuacuucgacccgggcaaaagcaucuccgagaacaucguuagcuuuauugaaaagucuuauaaauccaucuucgugcugagccccaacuuuguccagaaugaguggugccauuacgaguucuauuuugcccaccauaaccucuuccacgaaaauucugaucauauuauccugauucuccuggaaccuauccccuuuuacuguaucccuacccgguaucacaaacuuaaggcucugcucgaaaagaaggccuaccuggaguggcccaaagacagacgcaagugcggccuguucugggccaaccuucgggcugcggugaaugugaacguucuggccacaagagaaauguacgagcuccaaaccuucacggaacugaaugaggaaucccgcgggagcacaauuucucucaugcggaccgauugucuguga

SEQ ID NO: 9473 - protein, 811 aa, Artificial Sequence [sequence omitted]

SEQ ID NO: 9474 - RNA, 2436 nt, Artificial Sequence
  TLR10__Homo_sapiens__AAY78485
augagacucaucagaaacauuuacauauuuuguaguauuguuaugacagcagagggugaugcuccagagcugccagaagaaagggaacugaugaccaacugcuccaacaugucucuaagaaagguucccgcagacuugaccccagccacaacgacacuggauuuauccuauaacauccuuuuucaacuccagaguucagauuuucauucugucuccaaacugagaguuuugauucuaugccauaacagaauucaacagcuggaucucaaaaccuuugaauucaacaaggaguuaagauauuuagauuugucuaauaacagacugaagaguguaacuugguauuuacuggcaggucucagguauuuagaucuuucuuuuaaugacuuugacaccaugccuaucugugaggaagcuggcaacaugucacaccuggaaauccuagguuugaguggggcaaaaauacaaaaaucagauuuccagaaaauugcucaucugcaucuaaauacugucuucuuaggauucagaacucuuccucauuaugaagaagguagccugcccaucuuaaacacaacaaaacugcacauuguuuuaccaauggacacaaauuucuggguucuuuugcgugauggaaucaagacuucaaaaauauuagaaaugacaaauauagauggcaaaagccaauuuguaaguuaugaaaugcaacgaaaucuuaguuuagaaaaugcuaagacaucgguucuauugcuuaauaaaguugauuuacucugggacgaccuuuuccuuaucuuacaauuuguuuggcauacaucaguggaacacuuucagauccgaaaugugacuuuuggugguaaggcuuaucuugaccacaauucauuugacuacucaaauacuguaaugagaacuauaaaauuggagcauguacauuucagaguguuuuacauucaacaggauaaaaucuauuugcuuuugaccaaaauggacauagaaaaccugacaauaucaaaugcacaaaugccacacaugcuuuucccgaauuauccuacgaaauuccaauauuuaaauuuugccaauaauaucuuaacagacgaguuguuuaaaagaacuauccaacugccucacuugaaaacucucauuuugaauggcaauaaacuggagacacuuucuuuaguaaguugcuuugcuaacaacacacccuuggaacacuuggaucugagucaaaaucuauuacaacauaaaaaugaugaaaauugcucauggccagaaacuguggucaauaugaaucugucauacaauaaauugucugauucugucuucaggugcuugcccaaaaguauucaaauacuugaccuaaauaauaaccaaauccaaacuguaccuaaagagacuauucaucugauggccuuacgagaacuaaauauugcauuuaauuuucuaacugaucucccuggaugcagucauuucaguagacuuucaguucugaacauugaaaugaacuucauucucagcccaucucuggauuuuguucagagcugccaggaaguuaaaacucuaaaugcgggaagaaauccauuccgguguaccugugaauuaaaaaauuucauucagcuugaaacauauucagaggucaugaugguuggauggucagauucauacaccugugaauacccuuuaaaccuaaggggaacuagguuaaaagacguucaucuccacgaauuaucuugcaacacagcucuguugauugucaccauugugguuauuaugcuaguucugggguuggcuguggccuucugcugucuccacuuugaucugcccugguaucucaggaugcuaggucaaugcacacaaacauggcacaggguuaggaaaacaacccaagaacaacucaagagaaauguccgauuccacgcauuuauuucauacagugaacaugauucucugugggugaagaaugaauugauccccaaucuagagaaggaagaugguucuaucuugauuugccuuuaugaaagcuacuuugacccuggcaaaagcauuagugaaaauauuguaagcuucauugagaaaagcuauaaguccaucuuuguuuugucucccaacuuuguccagaaugaguggugccauuaugaauucuacuuugcccaccacaaucucuuccaugaaaauucugaucauauaauucuuaucuuacuggaacccauuccauucuauugcauucccaccagguaucauaaacugaaagcucuccuggaaaaaaaagcauacuuggaauggcccaaggauaggcguaaaugugggcuuuucugggcaaaccuucgagcugcuauuaauguuaauguauuagccaccagagaaauguaugaacugcagacauucacagaguuaaaugaagagucucgagguucuacaaucucucugaugagaacagauugucuauaa

SEQ ID NO: 9475 - RNA, 2436 nt, Artificial Sequence
  derived and/or modified sequence opt1 from TLR10__Homo_sapiens__AAY78485
augcgccugauccggaacaucuacaucuucugcagcaucgugaugaccgccgagggcgacgcccccgagcucccggaggagcgcgagcugaugaccaacugcuccaacaugagccugcggaagguccccgcggaccucacgcccgccaccaccacccuggaccuguccuacaacauccucuuccagcugcagagcuccgacuuccacagcguguccaagcugcgcgugcucauccugugccacaaccggauccagcagcuggaccucaagacguucgaguucaacaaggagcugcgcuaccuggaccucagcaacaaccggcugaaguccgucaccugguaccugcucgccgggcugcgcuaccuggaccucagcuucaacgacuucgacaccaugcccaucugcgaggaggccggcaacaugucccaccuggagauccuggggcucagcggcgccaagauccagaaguccgacuuccagaagaucgcgcaccuccaccugaacaccguguuccucggguuccggacgcugccgcacuacgaggagggcagccugcccauccucaacaccaccaagcugcacaucgugcugcccauggacaccaacuucuggguccuccugcgcgacggcaucaagacguccaagauccuggagaugaccaacaucgacgggaagucccaguucgugagcuacgagaugcagcggaaccucagccuggagaacgccaagaccuccgugcugcuccugaacaaggucgaccugcucugggacgaccuguuccugauccuccaguucguguggcacaccagcguggagcacuuccagauccgcaacgucacguucggcgggaaggccuaccuggaccacaacagcuucgacuacuccaacaccgugaugcggaccaucaagcuggagcacgugcacuuccgcgucuucuacauccagcaggacaagaucuaccuccugcugaccaagauggacaucgagaaccugacgaucagcaacgcccagaugccccacaugcuguucccgaacuaccccaccaaguuccaguaccugaacuucgcgaacaacauccugaccgacgagcuguucaagcggaccauccagcucccccaccugaagacgcucauccugaacggcaacaagcuggagacccucucccuggugagcugcuucgccaacaacacgccccuggagcaccucgaccugucccagaaccugcuccagcacaagaacgacgagaacugcagcuggccggagaccguggucaacaugaaccuguccuacaacaagcugagcgacuccguguuccgcugccuccccaagagcauccagauccuggaccugaacaacaaccagauccagaccgugcccaaggagaccauccaccucauggcccugcgggagcugaacaucgccuucaacuuccucaccgaccugcccgggugcucccacuucagccgccuguccguccucaacaucgagaugaacuucauccugagcccgucccuggacuucgugcagagcugccaggaggugaagacccucaacgccggccggaaccccuuccgcugcacgugcgagcugaagaacuucauccagcuggagaccuacuccgaggucaugauggugggcuggagcgacuccuacacgugcgaguacccccucaaccugcgggggacccgccugaaggacguccaccuccacgagcugagcugcaacaccgcgcugcucaucgugaccaucguggucaucaugcuggugcugggccucgccguggccuucugcugccugcacuucgaccugcccugguaccuccgcaugcuggggcagugcacccagaccuggcaccggguccgcaagaccacgcaggagcagcugaagcggaacgugcgcuuccacgccuucaucagcuacuccgagcacgacagccucugggugaagaacgagcugaucccgaaccuggagaaggaggacggcuccauccucaucugccuguacgagagcuacuucgaccccggcaaguccaucagcgagaacaucgucuccuucaucgagaaguccuacaagagcaucuucgugcugagccccaacuucgugcagaacgaguggugccacuacgaguucuacuucgcccaccacaaccucuuccacgagaacuccgaccacaucauccugauccugcucgagcccaucccguucuacugcauccccacccgguaccacaagcugaaggcgcugcucgagaagaaggccuaccuggaguggcccaaggaccgccggaagugcgggcuguucugggccaaccuccgcgccgccaucaacgucaacgugcuggcgacccgggagauguacgagcugcagaccuucacggagcucaacgaggagagccgcggcuccaccaucagccugaugcggaccgacugccuguga

SEQ ID NO: 9476 - RNA, 2436 nt, Artificial Sequence
  derived and/or modified sequence opt2 from TLR10__Homo_sapiens__AAY78485
augcgccucauccgcaacaucuacaucuucugcuccaucgucaugaccgccgagggcgacgcccccgagcuccccgaggagcgcgagcucaugaccaacugcuccaacaugucccuccgcaagguccccgccgaccucacccccgccaccaccacccucgaccucuccuacaacauccucuuccagcuccaguccuccgacuuccacuccgucuccaagcuccgcguccucauccucugccacaaccgcauccagcagcucgaccucaagaccuucgaguucaacaaggagcuccgcuaccucgaccucuccaacaaccgccucaaguccgucaccugguaccuccucgccggccuccgcuaccucgaccucuccuucaacgacuucgacaccaugcccaucugcgaggaggccggcaacaugucccaccucgagauccucggccucuccggcgccaagauccagaaguccgacuuccagaagaucgcccaccuccaccucaacaccgucuuccucggcuuccgcacccucccccacuacgaggagggcucccuccccauccucaacaccaccaagcuccacaucguccuccccauggacaccaacuucuggguccuccuccgcgacggcaucaagaccuccaagauccucgagaugaccaacaucgacggcaagucccaguucgucuccuacgagaugcagcgcaaccucucccucgagaacgccaagaccuccguccuccuccucaacaaggucgaccuccucugggacgaccucuuccucauccuccaguucgucuggcacaccuccgucgagcacuuccagauccgcaacgucaccuucggcggcaaggccuaccucgaccacaacuccuucgacuacuccaacaccgucaugcgcaccaucaagcucgagcacguccacuuccgcgucuucuacauccagcaggacaagaucuaccuccuccucaccaagauggacaucgagaaccucaccaucuccaacgcccagaugccccacaugcucuuccccaacuaccccaccaaguuccaguaccucaacuucgccaacaacauccucaccgacgagcucuucaagcgcaccauccagcucccccaccucaagacccucauccucaacggcaacaagcucgagacccucucccucgucuccugcuucgccaacaacaccccccucgagcaccucgaccucucccagaaccuccuccagcacaagaacgacgagaacugcuccuggcccgagaccgucgucaacaugaaccucuccuacaacaagcucuccgacuccgucuuccgcugccuccccaaguccauccagauccucgaccucaacaacaaccagauccagaccguccccaaggagaccauccaccucauggcccuccgcgagcucaacaucgccuucaacuuccucaccgaccuccccggcugcucccacuucucccgccucuccguccucaacaucgagaugaacuucauccucucccccucccucgacuucguccaguccugccaggaggucaagacccucaacgccggccgcaaccccuuccgcugcaccugcgagcucaagaacuucauccagcucgagaccuacuccgaggucaugauggucggcugguccgacuccuacaccugcgaguacccccucaaccuccgcggcacccgccucaaggacguccaccuccacgagcucuccugcaacaccgcccuccucaucgucaccaucgucgucaucaugcucguccucggccucgccgucgccuucugcugccuccacuucgaccuccccugguaccuccgcaugcucggccagugcacccagaccuggcaccgcguccgcaagaccacccaggagcagcucaagcgcaacguccgcuuccacgccuucaucuccuacuccgagcacgacucccucugggucaagaacgagcucauccccaaccucgagaaggaggacggcuccauccucaucugccucuacgaguccuacuucgaccccggcaaguccaucuccgagaacaucgucuccuucaucgagaaguccuacaaguccaucuucguccucucccccaacuucguccagaacgaguggugccacuacgaguucuacuucgcccaccacaaccucuuccacgagaacuccgaccacaucauccucauccuccucgagcccauccccuucuacugcauccccacccgcuaccacaagcucaaggcccuccucgagaagaaggccuaccucgaguggcccaaggaccgccgcaagugcggccucuucugggccaaccuccgcgccgccaucaacgucaacguccucgccacccgcgagauguacgagcuccagaccuucaccgagcucaacgaggagucccgcggcuccaccaucucccucaugcgcaccgacugccucuga

SEQ ID NO: 9477 - RNA, 2436 nt, Artificial Sequence
  derived and/or modified sequence opt3 from TLR10__Homo_sapiens__AAY78485
augagacugaucaggaacauuuacauauucugcagcaucgugaugaccgccgagggcgacgcucccgaacucccugaggaacgggagcuuaugacaaauuguuccaacaugucucugcgcaaggucccagcagauuugacuccggccacgaccacauuagaccugucauauaauauucuauuucagcuccaaaguagcgauuuccacuccguuucuaaacugcgagugcuuauccugugccauaaccguauucagcaguuggaccucaagacuuuugaguucaauaaagaacugagauaccuggaucucucgaacaauagguuaaagucaguaaccugguaucugcuugcgggguugcgguaccuggaccucagcuuuaacgauuucgacacaaugcccaucugugaggaagcuggaaauaugagucaccucgagauacugggucuuuccggcgccaaaauccagaagucugauuuucaaaagauugcacaucugcacuugaacaccguguuccucggguuucgcacucugccucauuaugaagagggaagccuuccaauccugaauacaaccaaacuccacauuguccuucccauggacacgaacuucugggugcuguugagagauggcaucaagacuuccaaaauacuagagaugaccaauauugacgguaagucacaguuuguuaguuacgaaaugcagaggaaccugagccucgagaaugccaaaacaucugugcugcuucugaacaaggucgauuugcucugggacgaccuguucuuaauccugcaguuuguguggcacacuuccguagaacauuuccaaauucggaacguuaccuucgggggaaaggcuuaucuagaucacaauucauuugacuacagcaacacagugaugcgcaccaucaaacucgagcauguccacuuccgaguguuuuacauccagcaggauaagauuuaucugcuuuugacgaaaauggacauagaaaaucugacuaucaguaacgcacagaugccucacaugcuauucccaaauuaccccacaaaguuucaauaucugaacuucgccaauaacauucuuaccgaugagcuguuuaaaagaacuauccaguugccucaucucaagacacugauauuaaauggcaacaaacuggagacccuaucucucguguccugcuucgcuaauaacacgccacuggaacaccuugacuugagccagaaucugcuccaacauaagaacgaugagaauuguucguggccggaaaccgucguuaacaugaaccugucuuacaauaaguuauccgacucaguguuuaggugccugcccaaaaguauucagauccuugauuugaacaauaaccagauccagacaguaccuaaggagacuauucaccucauggcccugcgggaacuaaauaucgcguucaacuuucugaccgaccucccaggcuguagccauuucucccgucugucugugcuuaauauugagaugaacuuuauauugagccccucacuggauuucguccaaaguugccaggaggugaaaacauuaaaugcagggcgcaacccuuucagauguacuugcgaacucaagaauuuuauccagcuggagaccuauuccgaaguuaugauggugggauggagcgacucuuacacaugugaguauccacuuaaccugagggguacccgguugaaagacguccaccuccacgaacugucaugcaauacugcccuacugauugugacgaucguaguuaucaugcucgugcugggccuugcugucgccuucugcuguuugcauuuugaucugcccugguacuuacgaaugcucgggcagugcacacaaaccuggcaccgcgugagaaagacuacccaggagcagcugaagaggaacguccgguuccaugcauuuauuaguuacagcgagcacgacucccuuugggugaaaaaugaacugauaccgaaccuagagaaggaagauggaucuauccucauuugucuguaugagucguacuucgacccuggcaaaagcaucuccgagaacauuguuucauuuaucgaaaagaguuauaaaucuauauucguguugagccccaauuuuguacagaacgaguggugccacuacgaguucuauuuugcucaucacaaucuguuccaugaaaacuccgaucacaucauuuuaauccuccuggaaccaauuccuuuuuacuguauccccacacgcuaucauaaguuaaaggcccuguuggagaaaaaggcguaccucgaguggccaaaagacagaaggaagugcggucuguucugggccaaucuacgugcagcuauaaacgucaaugugcuggccacccgggaaauguacgagcuucaaacuuucacagaacucaacgaggaaucacgagggagcacgauuucucugaugagaaccgauuguuuguga

SEQ ID NO: 9478 - RNA, 2436 nt, Artificial Sequence
  derived and/or modified sequence opt4 from TLR10__Homo_sapiens__AAY78485
augagacugaucagaaacaucuacaucuucugcagcaucgugaugaccgccgagggcgacgcccccgagcugcccgaggagagagagcugaugaccaacugcagcaacaugagccugagaaaggugcccgccgaccugacccccgccaccaccacccuggaccugagcuacaacauccuguuccagcugcagagcagcgacuuccacagcgugagcaagcugagagugcugauccugugccacaacagaauccagcagcuggaccugaagaccuucgaguucaacaaggagcugagauaccuggaccugagcaacaacagacugaagagcgugaccugguaccugcuggccggccugagauaccuggaccugagcuucaacgacuucgacaccaugcccaucugcgaggaggccggcaacaugagccaccuggagauccugggccugagcggcgccaagauccagaagagcgacuuccagaagaucgcccaccugcaccugaacaccguguuccugggcuucagaacccugccccacuacgaggagggcagccugcccauccugaacaccaccaagcugcacaucgugcugcccauggacaccaacuucugggugcugcugagagacggcaucaagaccagcaagauccuggagaugaccaacaucgacggcaagagccaguucgugagcuacgagaugcagagaaaccugagccuggagaacgccaagaccagcgugcugcugcugaacaagguggaccugcugugggacgaccuguuccugauccugcaguucguguggcacaccagcguggagcacuuccagaucagaaacgugaccuucggcggcaaggccuaccuggaccacaacagcuucgacuacagcaacaccgugaugagaaccaucaagcuggagcacgugcacuucagaguguucuacauccagcaggacaagaucuaccugcugcugaccaagauggacaucgagaaccugaccaucagcaacgcccagaugccccacaugcuguuccccaacuaccccaccaaguuccaguaccugaacuucgccaacaacauccugaccgacgagcuguucaagagaaccauccagcugccccaccugaagacccugauccugaacggcaacaagcuggagacccugagccuggugagcugcuucgccaacaacaccccccuggagcaccuggaccugagccagaaccugcugcagcacaagaacgacgagaacugcagcuggcccgagaccguggugaacaugaaccugagcuacaacaagcugagcgacagcguguucagaugccugcccaagagcauccagauccuggaccugaacaacaaccagauccagaccgugcccaaggagaccauccaccugauggcccugagagagcugaacaucgccuucaacuuccugaccgaccugcccggcugcagccacuucagcagacugagcgugcugaacaucgagaugaacuucauccugagccccagccuggacuucgugcagagcugccaggaggugaagacccugaacgccggcagaaaccccuucagaugcaccugcgagcugaagaacuucauccagcuggagaccuacagcgaggugaugauggugggcuggagcgacagcuacaccugcgaguacccccugaaccugagaggcaccagacugaaggacgugcaccugcacgagcugagcugcaacaccgcccugcugaucgugaccaucguggugaucaugcuggugcugggccuggccguggccuucugcugccugcacuucgaccugcccugguaccugagaaugcugggccagugcacccagaccuggcacagagugagaaagaccacccaggagcagcugaagagaaacgugagauuccacgccuucaucagcuacagcgagcacgacagccugugggugaagaacgagcugauccccaaccuggagaaggaggacggcagcauccugaucugccuguacgagagcuacuucgaccccggcaagagcaucagcgagaacaucgugagcuucaucgagaagagcuacaagagcaucuucgugcugagccccaacuucgugcagaacgaguggugccacuacgaguucuacuucgcccaccacaaccuguuccacgagaacagcgaccacaucauccugauccugcuggagcccauccccuucuacugcauccccaccagauaccacaagcugaaggcccugcuggagaagaaggccuaccuggaguggcccaaggacagaagaaagugcggccuguucugggccaaccugagagccgccaucaacgugaacgugcuggccaccagagagauguacgagcugcagaccuucaccgagcugaacgaggagagcagaggcagcaccaucagccugaugagaaccgacugccuguga

SEQ ID NO: 9479 - RNA, 2436 nt, Artificial Sequence
  derived and/or modified sequence opt5 from TLR10__Homo_sapiens__AAY78485
augagacugauccggaacauuuacaucuucugcagcauugugaugaccgccgagggcgacgcucccgaacucccugaggaacgcgagcugaugacaaauuguuccaacaugucucuuagaaaggucccggccgaucugacgcccgcgaccacaacccucgaccugagcuauaauauccuuuuucagcugcaauccucugauuuccacagcguuuccaaacuccgggugcugauucugugccauaaccgcauccagcagcucgaccugaagacauuugaguucaauaaagaacuuagauaccuggaucucucuaacaaucggcucaagagcgugaccugguaucuucuggcugggcuccgcuaccuggaccuguccuuuaacgauuucgacacaaugccuaucugugaggaagccggaaauaugagccaccucgagauucugggccuuucuggggccaaaauccagaaguccgauuuucaaaagauugcucaucugcaccucaacaccgucuuccugggauuuagaacgcuuccccauuaugaagagggcagccugccuauccucaauaccacaaaacugcacauugugcugcccauggacaccaacuucuggguucuccugcgggaugggaucaagacaucuaaaauucuugagaugaccaauaucgacggaaagucccaguuugugagcuacgaaaugcagcgcaaccugucucucgagaaugccaaaacguccguccugcuucugaacaagguggaucuccugugggacgaccuguuccucauccugcaguuuguuuggcacacaagcguggaacauuuccaaauuagaaacgucaccuucggcggcaaggcuuaucuugaucacaauuccuuugacuacucuaacacagugaugcggaccaucaaacuggagcaugugcacuuccgcgucuuuuacauucagcaggauaagaucuaucuccugcugaccaaaauggacauugaaaaucuuacaaucagcaacgcccagaugccucacaugcuguucccgaauuaccccacgaaguuucaauaucugaacuucgcgaauaacauccugaccgaugagcucuuuaaaagaacaauucagcugccucaucuuaagacccugauccucaaugggaacaaacuggagacacugucccuuguuagcugcuucgccaauaacacgccccucgaacaccuggaccugucucagaaucuccugcaacauaagaacgaugagaauuguuccuggccugaaaccguggugaacaugaaccuuagcuacaauaagcugucugacagcgucuuucggugccuccccaaauccauucagauccuggaucugaacaauaaccagauucagacagugccgaaggagaccauccaccuuauggcucuccgcgaacugaauaucgccuucaacuuucugaccgaccucccuggauguucucauuucagcagacuguccguucuuaauauugagaugaacuuuauccugagccccucucucgauuucgugcaauccugccaggaggucaaaacacugaaugcuggccggaacccuuucagauguaccugcgaacugaagaauuuuauucagcuugagacauauagcgaagugaugaugguuggguggucugacuccuacacgugugaguauccccucaaccugcgcggaacccggcugaaagacgugcaccuccacgaacugagcugcaauacagcccuucugaucgucaccauuguggucaucaugcucgugcugggccuggcgguugccuucugcugucuucauuuugaucugcccugguaccucagaaugcuggggcagugcacacaaaccuggcaccgcgugcggaagacgacccaggagcagcucaagagaaacguccgcuuccaugcuuuuauuuccuacucugagcacgacagccugugggugaaaaaugaacuuaucccuaaccuggagaaggaagauggauccauccucauuugucuguaugagucuuacuucgacccgggcaaaagcaucuccgagaacauuguuagcuuuaucgaaaagucuuauaaauccauuuucgugcugagccccaauuuuguccagaacgaguggugccacuacgaguucuauuuugcccaucacaaucuuuuccaugaaaacucugaucacaucauccugauucuccuggaaccuauccccuuuuacuguauuccuacacgguaucauaagcucaaggcucugcuugagaaaaaggccuaccuggaguggcccaaagacagacgcaagugcggccucuucugggccaaucugcgggcugcgaucaacgugaaugugcuggccaccagagaaauguacgagcuucaaacauucaccgaacugaacgaggaaucccgcgggagcacgauuucucucaugcggacagauugucuguga

SEQ ID NO: 9480 - protein, 811 aa, Artificial Sequence [sequence omitted]

SEQ ID NO: 9481 - RNA, 2436 nt, Artificial Sequence
  TLR10__Homo_sapiens__AAY78486
augagacucaucagaaacauuuacauauuuuguaguauuguuaugacagcagagggugaugcuccagagcugccagaagaaagggaacugaugaccaacugcuccaacaugucucuaagaaagguucccgcagacuugaccccagccacaacgacacuggauuuauccuauaaccuccuuuuucaacuccagaguucagauuuucauucugucuccaaacugagaguuuugauucuaugccauaacagaauucaacagcuggaucucaaaaccuuugaauucaacaaggaguuaagauauuuagauuugucuaauaacagacugaagaguguaacuugguauuuacuggcaggucucagguauuuagaucuuucuuuuaaugacuuugacaccaugccuaucugugaggaagcuggcaacaugucacaccuggaaauccuagguuugaguggggcaaaaauacaaaaaucagauuuccagaaaauugcucaucugcaucuaaauacugucuucuuaggauucagaacucuuccucauuaugaagaagguagccugcccaucuuaaacacaacaaaacugcacauuguuuuaccaauggacacaaauuucuggguucuuuugcgugauggaaucaagacuucaaaaauauuagaaaugacaaauauagauggcaaaagccaauuuguaaguuaugaaaugcaacgaaaucuuaguuuagaaaaugcuaagacaucgguucuauugcuuaauaaaguugauuuacucugggacgaccuuuuccuuaucuuacaauuuguuuggcauacaucaguggaacacuuucagauccgaaaugugacuuuuggugguaaggcuuaucuugaccacaauucauuugacuacucaaauacuguaaugagaacuauaaaauuggagcauguacauuucagaguguuuuacauucaacaggauaaaaucuauuugcuuuugaccaaaauggacauagaaaaccugacaauaucaaaugcacaaaugccacacaugcuuuucccgaauuauccuacgaaauuccaauauuuaaauuuugccaauaauaucuuaacagacgaguuguuuaaaagaacuauccaacugccucacuugaaaacucucauuuugaauggcaauaaacuggagacacuuucuuuaguaaguugcuuugcuaacaacacacccuuggaacacuuggaucugagucaaaaucuauuacaacauaaaaaugaugaaaauugcucauggccagaaacuguggucaauaugaaucugucauacaauaaauugucugauucugucuucaggugcuugcccaaaaguauucaaauacuugaccuaaauaauaaccaaauccaaacuguaccuaaagagacuauucaucugauggccuuacgagaacuaaauauugcauuuaauuuucuaacugaucucccuggaugcagucauuucaguagacuuucaguucugaacauugaaaugaacuucauucucagcccaucucuggauuuuguucagagcugccaggaaguuaaaacucuaaaugcgggaagaaauccauuccgguguaccugugaauuaaaaaauuucauucagcuugaaacauauucagaggucaugaugguuggauggucagauucauacaccugugaauacccuuuaaaccuaaggggaacuagguuaaaagacguucaucuccacgaauuaucuugcaacacagcucuguugauugucaccauugugguuauuaugcuaguucugggguuggcuguggccuucugcugucuccacuuugaucugcccugguaucucaggaugcuaggucaaugcacacaaacauggcacaggguuaggaaaacaacccaagaacaacucaagagaaauguccgauuccacgcauuuauuucauacagugaacaugauucucugugggugaagaaugaauugauccccaaucuagagaaggaagaugguucuaucuugauuugccuuuaugaaagcuacuuugacccuggcaaaagcauuagugaaaauauuguaagcuucauugagaaaagcuauaaguccaucuuuguuuugucucccaacuuuguccagaaugaguggugccauuaugaauucuacuuugcccaccacaaucucuuccaugaaaauucugaucauauaauucuuaucuuacuggaacccauuccauucuauugcauucccaccagguaucauaaacugaaagcucuccuggaaaaaaaagcauacuuggaauggcccaaggauaggcguaaaugugggcuuuucugggcaaaccuucgagcugcuauuaauguuaauguauuagccaccagagaaauguaugaacugcagacauucacagaguuaaaugaagagucucaagguucuacaaucucucugaugagaacagauugucuauaa

SEQ ID NO: 9482 - RNA, 2436 nt, Artificial Sequence
  derived and/or modified sequence opt1 from TLR10__Homo_sapiens__AAY78486
augcgccugauccggaacaucuacaucuucugcagcaucgugaugaccgccgagggcgacgcccccgagcucccggaggagcgcgagcugaugaccaacugcuccaacaugagccugcggaagguccccgcggaccucacgcccgccaccaccacccuggaccuguccuacaaccuccuguuccagcugcagagcuccgacuuccacagcguguccaagcuccgcgugcugauccugugccacaaccggauccagcagcucgaccugaagacguucgaguucaacaaggagcugcgcuaccucgaccugagcaacaaccggcugaaguccgucaccugguaccuccuggccgggcugcgcuaccucgaccugagcuucaacgacuucgacaccaugcccaucugcgaggaggccggcaacaugucccaccuggagauccucgggcugagcggcgccaagauccagaaguccgacuuccagaagaucgcgcaccuccaccucaacaccguguuccugggguuccggacgcugccgcacuacgaggagggcagccuccccauccugaacaccaccaagcugcacaucgugcuccccauggacaccaacuucuggguccugcugcgcgacggcaucaagacguccaagauccucgagaugaccaacaucgacgggaagucccaguucgugagcuacgagaugcagcggaaccugagccuggagaacgccaagaccuccgugcuccugcugaacaaggucgaccuccugugggacgaccuguuccucauccugcaguucguguggcacaccagcguggagcacuuccagauccgcaacgucacguucggcgggaaggccuaccuggaccacaacagcuucgacuacuccaacaccgugaugcggaccaucaagcucgagcacgugcacuuccgcgucuucuacauccagcaggacaagaucuaccugcugcugaccaagauggacaucgagaaccucacgaucagcaacgcccagaugccccacaugcuguucccgaacuaccccaccaaguuccaguaccugaacuucgcgaacaacauccucaccgacgagcuguucaagcggaccauccagcugccccaccucaagacgcugauccugaacggcaacaagcucgagacccugucccuggugagcugcuucgccaacaacacgccccucgagcaccuggaccugucccagaaccuccugcagcacaagaacgacgagaacugcagcuggccggagaccguggucaacaugaaccuguccuacaacaagcucagcgacuccguguuccgcugccugcccaagagcauccagauccuggaccucaacaacaaccagauccagaccgugcccaaggagaccauccaccugauggcccugcgggagcucaacaucgccuucaacuuccugaccgaccugcccgggugcucccacuucagccgccucuccguccugaacaucgagaugaacuucauccugagcccgucccucgacuucgugcagagcugccaggaggugaagacccugaacgccggccggaaccccuuccgcugcacgugcgagcugaagaacuucauccagcucgagaccuacuccgaggucaugauggugggcuggagcgacuccuacacgugcgaguacccccugaaccugcgggggacccgccucaaggacguccaccuccacgagcugagcugcaacaccgcgcugcugaucgugaccaucguggucaucaugcuggugcucggccuggccguggccuucugcugccugcacuucgaccuccccugguaccugcgcaugcuggggcagugcacccagaccuggcaccggguccgcaagaccacgcaggagcagcucaagcggaacgugcgcuuccacgccuucaucagcuacuccgagcacgacagccugugggugaagaacgagcugaucccgaaccucgagaaggaggacggcuccauccugaucugccuguacgagagcuacuucgaccccggcaaguccaucagcgagaacaucgucuccuucaucgagaaguccuacaagagcaucuucgugcucagccccaacuucgugcagaacgaguggugccacuacgaguucuacuucgcccaccacaaccuguuccacgagaacuccgaccacaucauccugauccuccuggagcccaucccguucuacugcauccccacccgguaccacaagcugaaggcgcuccuggagaagaaggccuaccuggaguggcccaaggaccgccggaagugcgggcuguucugggccaaccugcgcgccgccaucaacgucaacgugcuggcgacccgggagauguacgagcuccagaccuucacggagcugaacgaggagagccagggcuccaccaucagccugaugcgcaccgacugccucuga

SEQ ID NO: 9483 - RNA, 2436 nt, Artificial Sequence
  derived and/or modified sequence opt2 from TLR10__Homo_sapiens__AAY78486
augcgccucauccgcaacaucuacaucuucugcuccaucgucaugaccgccgagggcgacgcccccgagcuccccgaggagcgcgagcucaugaccaacugcuccaacaugucccuccgcaagguccccgccgaccucacccccgccaccaccacccucgaccucuccuacaaccuccucuuccagcuccaguccuccgacuuccacuccgucuccaagcuccgcguccucauccucugccacaaccgcauccagcagcucgaccucaagaccuucgaguucaacaaggagcuccgcuaccucgaccucuccaacaaccgccucaaguccgucaccugguaccuccucgccggccuccgcuaccucgaccucuccuucaacgacuucgacaccaugcccaucugcgaggaggccggcaacaugucccaccucgagauccucggccucuccggcgccaagauccagaaguccgacuuccagaagaucgcccaccuccaccucaacaccgucuuccucggcuuccgcacccucccccacuacgaggagggcucccuccccauccucaacaccaccaagcuccacaucguccuccccauggacaccaacuucuggguccuccuccgcgacggcaucaagaccuccaagauccucgagaugaccaacaucgacggcaagucccaguucgucuccuacgagaugcagcgcaaccucucccucgagaacgccaagaccuccguccuccuccucaacaaggucgaccuccucugggacgaccucuuccucauccuccaguucgucuggcacaccuccgucgagcacuuccagauccgcaacgucaccuucggcggcaaggccuaccucgaccacaacuccuucgacuacuccaacaccgucaugcgcaccaucaagcucgagcacguccacuuccgcgucuucuacauccagcaggacaagaucuaccuccuccucaccaagauggacaucgagaaccucaccaucuccaacgcccagaugccccacaugcucuuccccaacuaccccaccaaguuccaguaccucaacuucgccaacaacauccucaccgacgagcucuucaagcgcaccauccagcucccccaccucaagacccucauccucaacggcaacaagcucgagacccucucccucgucuccugcuucgccaacaacaccccccucgagcaccucgaccucucccagaaccuccuccagcacaagaacgacgagaacugcuccuggcccgagaccgucgucaacaugaaccucuccuacaacaagcucuccgacuccgucuuccgcugccuccccaaguccauccagauccucgaccucaacaacaaccagauccagaccguccccaaggagaccauccaccucauggcccuccgcgagcucaacaucgccuucaacuuccucaccgaccuccccggcugcucccacuucucccgccucuccguccucaacaucgagaugaacuucauccucucccccucccucgacuucguccaguccugccaggaggucaagacccucaacgccggccgcaaccccuuccgcugcaccugcgagcucaagaacuucauccagcucgagaccuacuccgaggucaugauggucggcugguccgacuccuacaccugcgaguacccccucaaccuccgcggcacccgccucaaggacguccaccuccacgagcucuccugcaacaccgcccuccucaucgucaccaucgucgucaucaugcucguccucggccucgccgucgccuucugcugccuccacuucgaccuccccugguaccuccgcaugcucggccagugcacccagaccuggcaccgcguccgcaagaccacccaggagcagcucaagcgcaacguccgcuuccacgccuucaucuccuacuccgagcacgacucccucugggucaagaacgagcucauccccaaccucgagaaggaggacggcuccauccucaucugccucuacgaguccuacuucgaccccggcaaguccaucuccgagaacaucgucuccuucaucgagaaguccuacaaguccaucuucguccucucccccaacuucguccagaacgaguggugccacuacgaguucuacuucgcccaccacaaccucuuccacgagaacuccgaccacaucauccucauccuccucgagcccauccccuucuacugcauccccacccgcuaccacaagcucaaggcccuccucgagaagaaggccuaccucgaguggcccaaggaccgccgcaagugcggccucuucugggccaaccuccgcgccgccaucaacgucaacguccucgccacccgcgagauguacgagcuccagaccuucaccgagcucaacgaggagucccagggcuccaccaucucccucaugcgcaccgacugccucuga

SEQ ID NO: 9484 - RNA, 2436 nt, Artificial Sequence
  derived and/or modified sequence opt3 from TLR10__Homo_sapiens__AAY78486
augagacugaucaggaacauuuacauauucugcagcaucgugaugaccgccgagggcgacgcucccgaacucccugaggaacgggagcuuaugacaaauuguuccaacaugucucugcgcaaggucccagcagauuugacuccggccacgaccacauuagaccugucauauaaucuacucuuucagcugcaaaguagcgauuuccacuccguuucuaaacuucgagugcugauuuugugccauaaccguauccagcagcucgaccugaagacuuuugaguucaauaaagaacugagauaccucgauuuaucgaacaauaggcugaagucaguaaccugguaucuuuuggcggggcugcgguaccuagaccucagcuuuaacgauuucgacacaaugcccauuugugaggaagcuggaaauaugagucaccuggagauccuuggucuguccggcgccaaaauacagaagucugauuuucaaaagaucgcacauuugcaccucaacaccguguuccugggguuucgcacuuuaccucauuaugaagagggaagccugccaauucucaauacaaccaaacuucacaucguccugcccauggacacgaacuucuggguguugcuaagagauggcauuaagacuuccaaaauccuggagaugaccaauauagacgguaagucacaguuuguuaguuacgaaaugcagaggaaccucagccuggagaaugccaaaacaucugugcuucuguugaacaaggucgaucuccugugggacgacuuauuccugauucuacaguuuguguggcacacuuccguagaacauuuccaaauccggaacguuaccuucgggggaaaggcuuaucucgaucacaauucauuugacuacagcaacacagugaugcgcaccauuaaacuggagcauguccacuuccgaguguuuuacauccagcaggauaagaucuaucuuuugcugacgaaaauggacauugaaaaucucacuauaaguaacgcacagaugccucacaugcuguucccaaauuaccccacaaaguuucaauaucuuaacuucgccaauaacauccugaccgaugaguuguuuaaaagaacuauucagcucccucaucugaagacauuaauccugaauggcaacaaacuagagacccucucucugguguccugcuucgcuaauaacacgccacuugaacacuuggaccugagccagaaucuccugcaacauaagaacgaugagaauuguucguggccggaaaccgucguuaacaugaacuuaucuuacaauaagcuguccgacucaguguuuaggugccuucccaaaaguauacagauuuuggaucucaacaauaaccagauccagacaguaccuaaggagacuauccaccugauggcccuacgggaacugaauauugcguucaacuuucucaccgaccugccaggcuguagccauuucucccgucuuucuguguugaauaucgagaugaacuuuauucugagccccucauuagauuucguccaaaguugccaggaggugaaaacacucaaugcagggcgcaacccuuucagauguacuugcgaacugaagaauuuuauacagcuugagaccuauuccgaaguuaugauggugggauggagcgacucuuacacaugugaguauccacugaacuugagggguacccggcucaaagacguccaucugcacgaacuaucaugcaauacugcccugcucaucgugacgauuguaguuaucaugcuggugcuuggcuuggcugucgccuucugcugucugcacuuugauuuacccugguaccuccgaaugcuggggcagugcacacaaaccuggcaccgcgugagaaagacuacccaggagcagcuuaagaggaacguccgguuccaugcauuuaucaguuacagcgagcacgacucccugugggugaaaaaugaacuaauuccgaaccucgagaaggaagauggaucuauacugaucuguuuguaugagucguacuucgacccuggcaaaagcauuuccgagaacaucguuucauuuauugaaaagaguuauaaaucuaucuucgugcugagccccaauuuuguacagaacgaguggugccacuacgaguucuauuuugcucaucacaauuuauuccaugaaaacuccgaucacauaauccucauucugcuugaaccaaucccuuuuuacuguauucccacacgcuaucauaagcugaaggccuugcucgagaaaaaggcguaccuggaguggccaaaagacagaaggaagugcggucuauucugggccaaucugcgugcagcuaucaacgucaaugugcuugccacccgggaaauguacgagcuccaaacuuucacagaacugaacgaggaaucacaggggagcacgauaucuuugaugcgaaccgauugucuguga

SEQ ID NO: 9485 - RNA, 2436 nt, Artificial Sequence
  derived and/or modified sequence opt4 from TLR10__Homo_sapiens__AAY78486
augagacugaucagaaacaucuacaucuucugcagcaucgugaugaccgccgagggcgacgcccccgagcugcccgaggagagagagcugaugaccaacugcagcaacaugagccugagaaaggugcccgccgaccugacccccgccaccaccacccuggaccugagcuacaaccugcuguuccagcugcagagcagcgacuuccacagcgugagcaagcugagagugcugauccugugccacaacagaauccagcagcuggaccugaagaccuucgaguucaacaaggagcugagauaccuggaccugagcaacaacagacugaagagcgugaccugguaccugcuggccggccugagauaccuggaccugagcuucaacgacuucgacaccaugcccaucugcgaggaggccggcaacaugagccaccuggagauccugggccugagcggcgccaagauccagaagagcgacuuccagaagaucgcccaccugcaccugaacaccguguuccugggcuucagaacccugccccacuacgaggagggcagccugcccauccugaacaccaccaagcugcacaucgugcugcccauggacaccaacuucugggugcugcugagagacggcaucaagaccagcaagauccuggagaugaccaacaucgacggcaagagccaguucgugagcuacgagaugcagagaaaccugagccuggagaacgccaagaccagcgugcugcugcugaacaagguggaccugcugugggacgaccuguuccugauccugcaguucguguggcacaccagcguggagcacuuccagaucagaaacgugaccuucggcggcaaggccuaccuggaccacaacagcuucgacuacagcaacaccgugaugagaaccaucaagcuggagcacgugcacuucagaguguucuacauccagcaggacaagaucuaccugcugcugaccaagauggacaucgagaaccugaccaucagcaacgcccagaugccccacaugcuguuccccaacuaccccaccaaguuccaguaccugaacuucgccaacaacauccugaccgacgagcuguucaagagaaccauccagcugccccaccugaagacccugauccugaacggcaacaagcuggagacccugagccuggugagcugcuucgccaacaacaccccccuggagcaccuggaccugagccagaaccugcugcagcacaagaacgacgagaacugcagcuggcccgagaccguggugaacaugaaccugagcuacaacaagcugagcgacagcguguucagaugccugcccaagagcauccagauccuggaccugaacaacaaccagauccagaccgugcccaaggagaccauccaccugauggcccugagagagcugaacaucgccuucaacuuccugaccgaccugcccggcugcagccacuucagcagacugagcgugcugaacaucgagaugaacuucauccugagccccagccuggacuucgugcagagcugccaggaggugaagacccugaacgccggcagaaaccccuucagaugcaccugcgagcugaagaacuucauccagcuggagaccuacagcgaggugaugauggugggcuggagcgacagcuacaccugcgaguacccccugaaccugagaggcaccagacugaaggacgugcaccugcacgagcugagcugcaacaccgcccugcugaucgugaccaucguggugaucaugcuggugcugggccuggccguggccuucugcugccugcacuucgaccugcccugguaccugagaaugcugggccagugcacccagaccuggcacagagugagaaagaccacccaggagcagcugaagagaaacgugagauuccacgccuucaucagcuacagcgagcacgacagccugugggugaagaacgagcugauccccaaccuggagaaggaggacggcagcauccugaucugccuguacgagagcuacuucgaccccggcaagagcaucagcgagaacaucgugagcuucaucgagaagagcuacaagagcaucuucgugcugagccccaacuucgugcagaacgaguggugccacuacgaguucuacuucgcccaccacaaccuguuccacgagaacagcgaccacaucauccugauccugcuggagcccauccccuucuacugcauccccaccagauaccacaagcugaaggcccugcuggagaagaaggccuaccuggaguggcccaaggacagaagaaagugcggccuguucugggccaaccugagagccgccaucaacgugaacgugcuggccaccagagagauguacgagcugcagaccuucaccgagcugaacgaggagagccagggcagcaccaucagccugaugagaaccgacugccuguga

SEQ ID NO: 9486 - RNA, 2436 nt, Artificial Sequence
  derived and/or modified sequence opt5 from TLR10__Homo_sapiens__AAY78486
augagacugauccggaacauuuacaucuucugcagcauugugaugaccgccgagggcgacgcucccgaacucccugaggaacgcgagcugaugacaaauuguuccaacaugucucuuagaaaggucccggccgaucugacgcccgcgaccacaacccucgaccugagcuauaaucuucuguuucagcuccaauccucugauuuccacagcguuuccaaacugcgggugcugauccucugccauaaccgcauucagcagcuggaccuuaagacauuugaguucaauaaagaacugagauaccucgaucugucuaacaaucggcuuaagagcgugaccugguaucugcucgcugggcugcgcuaccuggaccucuccuuuaacgauuucgacacaaugccuaucugugaggaagccggaaauaugagccaccuggagauccuuggccugucuggggccaaaauucagaaguccgauuuucaaaagaucgcucaucuccaccugaacaccgucuuccuuggauuuagaacgcugccccauuaugaagagggcagccucccuauucugaauaccacaaaacugcacaucgugcuccccauggacaccaacuucuggguucugcuucgggaugggauuaagacaucuaaaauccuggagaugaccaauauugacggaaagucccaguuugugagcuacgaaaugcagcgcaaccucucucuggagaaugccaaaacguccguccuucugcucaacaagguggaucugcugugggacgaccucuuccugauccuucaguuuguuuggcacacaagcguggaacauuuccaaaucagaaacgucaccuucggcggcaaggcuuaucuggaucacaauuccuuugacuacucuaacacagugaugcggaccauuaaacucgagcaugugcacuuccgcgucuuuuacauccagcaggauaagauuuaucugcugcuuaccaaaauggacaucgaaaaucucacaauuagcaacgcccagaugccucacaugcuguucccgaauuaccccacgaaguuucaauaucugaacuucgcgaauaacauccucaccgaugagcuguuuaaaagaacaauccagcuuccucaucugaagacccucauucugaaugggaacaaacuggagacacuuucccucguuagcugcuucgccaauaacacgccccuggaacaccuggaccucucucagaaucugcuucaacauaagaacgaugagaauuguuccuggccugaaaccguggugaacaugaaccugagcuacaauaagcucucugacagcgucuuucggugccugcccaaauccauccagauucuggaucuuaacaauaaccagauccagacagugccgaaggagaccauucaccucauggcucugcgcgaacugaauaucgccuucaacuuucucaccgaccugccuggauguucucauuucagcagacuuuccguucugaauaucgagaugaacuuuauucucagccccucucuggauuucgugcaauccugccaggaggucaaaacacugaaugcuggccggaacccuuucagauguaccugcgaacuuaagaauuuuauccagcucgagacauauagcgaagugaugaugguuggguggucugacuccuacacgugugaguauccccugaaccugcgcggaacccggcucaaagacgugcaccuucacgaacuuagcugcaauacagcccugcucauugucaccaucguggucauuaugcuggugcugggccuugcgguugccuucugcugucugcauuuugaucuccccugguaccugagaaugcucgggcagugcacacaaaccuggcaccgcgugcggaagacgacccaggagcagcugaagagaaacguccgcuuccaugcuuuuaucuccuacucugagcacgacagccuuugggugaaaaaugaacugauuccuaaccucgagaaggaagauggauccauccugaucugucuguaugagucuuacuucgacccgggcaaaagcauuuccgagaacaucguuagcuuuauugaaaagucuuauaaauccaucuucgugcuuagccccaauuuuguccagaacgaguggugccacuacgaguucuauuuugcccaucacaaucuguuccaugaaaacucugaucacauuauccucauccugcucgaaccuauucccuuuuacuguaucccuacacgguaucauaagcugaaggcucugcuggagaaaaaggccuaccucgaguggcccaaagacagacgcaagugcggccuguucugggccaaucugcgggcugcgauuaacgugaaugugcuugccaccagagaaauguacgagcugcaaacauucaccgaacucaacgaggaaucccaggggagcacgaucucucugaugcgcacagauugucucuga

SEQ ID NO: 9487 - protein, 811 aa, Artificial Sequence [sequence omitted]

SEQ ID NO: 9488 - RNA, 2436 nt, Artificial Sequence
  TLR10__Homo_sapiens__AAY78487
augagacucaucagaaacauuuacauauuuuguaguauaguuaugacagcagagggugaugcuccagagcugccagaagaaagggaacugaugaccaacugcuccaacaugucucuaagaaagguucccgcagacuugaccccagccacaacaacacuggauuuauccuauaaccuccuuuuucaacuccagaguucagauuuucauucugucuccaaacugagaguuuugauucuaugccauaacagaauucaacagcuggaucucaaaaccuuugaauucaacaaggaguuaagauauuuagauuugucuaauaacagacugaagaguguaacuugguauuuacuggcaggucucagguauuuagaucuuucuuuuaaugacuuugacaccaugccuaucugugaggaagcuggcaacaugucacaccuggaaauccuagguuugaguggggcaaaaauacaaaaaucagauuuccagaaaauuucucaucugcaucuaaauacugucuucuuaggauucagaacucuuccucauuaugaagaagguagccugcccaucuuaaacacaacaaaacugcacauuguuuuaccaauggacacaaauuucuggguucuuuugcgugauggaaucaagacuucaaaaauauuagaaaugacaaauauagauggcaaaagccaauuuguaaguuaugaaaugcaacgaaaucuuaguuuagaacaugcuaagacaucgguucuauugcuuaauaaaguugauuuacucugggacgaccuuuuccuuaucuuacaauuuguuuggcauacaucaguggaacacuuucagauccgaaaugugacuuuuggugguaaggcuuaucuugaccacaauucauuugacuacucaaauacuauaaugagaacuauaaaauuggagcauguacauuucagaguguuuuacauucaacaggauaaaaucuauuugcuuuugaccaaaauggacauagaaaaccugacaauaucaaaugcacaaaugccacacaugcuuuucccuaauuauccuacgaaauuccaauauuuaaauuuugccaauaauaucuuaacagacgaguuguuuaaaagaacucuccaacugccucacuugaaaacucucauuuugaauggcaauaaacuggagacacuuucuuuaguaaguugcuuugcuaacaacacacccuuggaacacuuggaucugagucaaaaucuauuacaacauaaaaaugaugaaaauugcucauggccagaaacuguggucaauaugaaucugucauacaauaaauugucugauucugucuucaggugcuugcccaaaaguauucaaauacuugaccuaaauaauaaccaaauccaaacuguaccuaaagagacuauucaucugauggccuuacgagaacuaaauauugcauuuaauuuucuaacugaucucccuggaugcagucauuucaguagacuuucaguucugaacauugaaaugaacuucauucucagcccaucucuggauuuuguucagagcugccaggaaguuaaaacucuaaaugcgggaagaaauccauuccgguguaccugugaauuaaaaaauuucauucagcuugaaacauauucagaggucaugaugguuggauggucagauucauacaccugugaauacccuuuaaaccuaaggggaacuagguuaaaagacguucaucuccacgaauuaucuugcaacacagcucuguugauugucaccauugugguuauuaugcuaguucugggguuggcuguggccuucugcugucuccacuuugaucugcccugguaucucaggaugcuaggucaaugcacacaaacauggcacaggguuaggaaaacaacccaagaacaacucaagagaaauguccgauuccacgcauuuauuucauacagugaacaugauucucugugggugaagaaugaauugauccccaaucuagagaaggaagaugguucuaucuugauuugccuuuaugaaagcuacuuugacccuggcaaaagcauuagugaaaauauuguaagcuucauugagaaaagcuauaaguccaucuuuguuuugucucccaacuuuguccagaaugaguggugccauuaugaauucuacuuugcccaccacaaucucuuccaugaaaauucugaucacauaauucuuaucuuacuggaacccauuccauucuauugcauucccaccagguaucauaaacugaaagcucuccuggaaaaaaaagcauacuuggaauggcccaaggauaggcguaaaugugggcuuuucugggcaaaccuucgagcugcuauuaauguuaauguauuagccaccagagaaauguaugaacugcagacauucacagaguuaaaugaagagucucgagguucuacaaucucucugaugagaacagacugucuauaa

SEQ ID NO: 9489 - RNA, 2436 nt, Artificial Sequence
  derived and/or modified sequence opt1 from TLR10__Homo_sapiens__AAY78487
augcgccugauccggaacaucuacaucuucugcagcaucgugaugaccgccgagggcgacgcccccgagcucccggaggagcgcgagcugaugaccaacugcuccaacaugagccugcggaagguccccgcggaccucacgcccgccaccaccacccuggaccuguccuacaaccuccuguuccagcugcagagcuccgacuuccacagcguguccaagcuccgcgugcugauccugugccacaaccggauccagcagcucgaccugaagacguucgaguucaacaaggagcugcgcuaccucgaccugagcaacaaccggcugaaguccgucaccugguaccuccuggccgggcugcgcuaccucgaccugagcuucaacgacuucgacaccaugcccaucugcgaggaggccggcaacaugucccaccuggagauccucgggcugagcggcgccaagauccagaaguccgacuuccagaagaucagccaccuccaccugaacaccguguuccugggguuccggacgcugccgcacuacgaggagggcucccuccccauccugaacaccaccaagcugcacaucgugcuccccauggacaccaacuucuggguccugcugcgcgacggcaucaagacgagcaagauccucgagaugaccaacaucgacgggaagucccaguucgugagcuacgagaugcagcggaaccugucccuggagcacgcgaagaccagcgugcuccugcugaacaaggucgaccuccugugggacgaccuguuccucauccugcaguucguguggcacaccagcguggagcacuuccagauccgcaacgucacguucggcgggaaggccuaccuggaccacaacuccuucgacuacagcaacaccaucaugcggaccaucaagcucgagcacgugcacuuccgcguguucuacauccagcaggacaagaucuaccugcugcugaccaagauggacaucgagaaccucacgaucuccaacgcccagaugccccacaugcuguucccgaacuaccccaccaaguuccaguaccugaacuucgccaacaacauccucaccgacgagcuguucaagcggacccugcagcucccccaccugaagacgcugauccucaacggcaacaagcuggagacccugagccucgucuccugcuucgcgaacaacacgccccuggagcaccuggaccucagccagaaccugcugcagcacaagaacgacgagaacugcuccuggccggagaccguggugaacaugaaccucagcuacaacaagcuguccgacagcgucuuccgcugccugcccaaguccauccagauccucgaccugaacaacaaccagauccagaccgugcccaaggagaccauccaccugauggcccuccgggagcugaacaucgccuucaacuuccugaccgaccuccccgggugcagccacuucucccgccugagcgugcugaacaucgagaugaacuucauccucuccccgagccuggacuucguccaguccugccaggaggugaagacccugaacgccggccggaaccccuuccgcugcacgugcgagcucaagaacuucauccagcuggagaccuacagcgaggugaugauggucggcugguccgacagcuacacgugcgaguacccccugaaccuccgggggacccgccugaaggacgugcaccuccacgagcugagcugcaacaccgcccugcugaucgucaccaucguggugaucaugcucguccugggccuggcgguggccuucugcugccuccacuucgaccugcccugguaccugcgcaugcucgggcagugcacccagaccuggcaccgggugcgcaagaccacgcaggagcagcugaagcggaacguccgcuuccacgccuucaucuccuacagcgagcacgacucccugugggugaagaacgagcucaucccgaaccuggagaaggaggacggcagcauccugaucugccucuacgaguccuacuucgaccccggcaagagcaucuccgagaacaucgugagcuucaucgagaaguccuacaagagcaucuucguccugucccccaacuucgugcagaacgaguggugccacuacgaguucuacuucgcccaccacaaccuguuccacgagaacagcgaccacaucauccucauccugcuggagcccaucccguucuacugcauccccacccgguaccacaagcucaaggcccugcuggagaagaaggcguaccucgaguggcccaaggaccgccggaagugcgggcuguucugggccaaccugcgcgccgccaucaacgugaacguccucgccacccgggagauguacgagcugcagaccuucacggagcugaacgaggagucccgcggcagcaccaucucccucaugcggaccgacugccuguga

SEQ ID NO: 9490 - RNA, 2436 nt, Artificial Sequence
  derived and/or modified sequence opt2 from TLR10__Homo_sapiens__AAY78487
augcgccucauccgcaacaucuacaucuucugcuccaucgucaugaccgccgagggcgacgcccccgagcuccccgaggagcgcgagcucaugaccaacugcuccaacaugucccuccgcaagguccccgccgaccucacccccgccaccaccacccucgaccucuccuacaaccuccucuuccagcuccaguccuccgacuuccacuccgucuccaagcuccgcguccucauccucugccacaaccgcauccagcagcucgaccucaagaccuucgaguucaacaaggagcuccgcuaccucgaccucuccaacaaccgccucaaguccgucaccugguaccuccucgccggccuccgcuaccucgaccucuccuucaacgacuucgacaccaugcccaucugcgaggaggccggcaacaugucccaccucgagauccucggccucuccggcgccaagauccagaaguccgacuuccagaagaucucccaccuccaccucaacaccgucuuccucggcuuccgcacccucccccacuacgaggagggcucccuccccauccucaacaccaccaagcuccacaucguccuccccauggacaccaacuucuggguccuccuccgcgacggcaucaagaccuccaagauccucgagaugaccaacaucgacggcaagucccaguucgucuccuacgagaugcagcgcaaccucucccucgagcacgccaagaccuccguccuccuccucaacaaggucgaccuccucugggacgaccucuuccucauccuccaguucgucuggcacaccuccgucgagcacuuccagauccgcaacgucaccuucggcggcaaggccuaccucgaccacaacuccuucgacuacuccaacaccaucaugcgcaccaucaagcucgagcacguccacuuccgcgucuucuacauccagcaggacaagaucuaccuccuccucaccaagauggacaucgagaaccucaccaucuccaacgcccagaugccccacaugcucuuccccaacuaccccaccaaguuccaguaccucaacuucgccaacaacauccucaccgacgagcucuucaagcgcacccuccagcucccccaccucaagacccucauccucaacggcaacaagcucgagacccucucccucgucuccugcuucgccaacaacaccccccucgagcaccucgaccucucccagaaccuccuccagcacaagaacgacgagaacugcuccuggcccgagaccgucgucaacaugaaccucuccuacaacaagcucuccgacuccgucuuccgcugccuccccaaguccauccagauccucgaccucaacaacaaccagauccagaccguccccaaggagaccauccaccucauggcccuccgcgagcucaacaucgccuucaacuuccucaccgaccuccccggcugcucccacuucucccgccucuccguccucaacaucgagaugaacuucauccucucccccucccucgacuucguccaguccugccaggaggucaagacccucaacgccggccgcaaccccuuccgcugcaccugcgagcucaagaacuucauccagcucgagaccuacuccgaggucaugauggucggcugguccgacuccuacaccugcgaguacccccucaaccuccgcggcacccgccucaaggacguccaccuccacgagcucuccugcaacaccgcccuccucaucgucaccaucgucgucaucaugcucguccucggccucgccgucgccuucugcugccuccacuucgaccuccccugguaccuccgcaugcucggccagugcacccagaccuggcaccgcguccgcaagaccacccaggagcagcucaagcgcaacguccgcuuccacgccuucaucuccuacuccgagcacgacucccucugggucaagaacgagcucauccccaaccucgagaaggaggacggcuccauccucaucugccucuacgaguccuacuucgaccccggcaaguccaucuccgagaacaucgucuccuucaucgagaaguccuacaaguccaucuucguccucucccccaacuucguccagaacgaguggugccacuacgaguucuacuucgcccaccacaaccucuuccacgagaacuccgaccacaucauccucauccuccucgagcccauccccuucuacugcauccccacccgcuaccacaagcucaaggcccuccucgagaagaaggccuaccucgaguggcccaaggaccgccgcaagugcggccucuucugggccaaccuccgcgccgccaucaacgucaacguccucgccacccgcgagauguacgagcuccagaccuucaccgagcucaacgaggagucccgcggcuccaccaucucccucaugcgcaccgacugccucuga

SEQ ID NO: 9491 - RNA, 2436 nt, Artificial Sequence
  derived and/or modified sequence opt3 from TLR10__Homo_sapiens__AAY78487
augagacugaucaggaacauuuacauauucugcagcaucgugaugaccgccgagggcgacgcucccgaacucccugaggaacgggagcuuaugacaaauuguuccaacaugucucugcgcaaggucccagcagauuugacuccggccacgaccacauuagaccugucauauaaucuacucuuucagcugcaaaguagcgauuuccacuccguuucuaaacuucgagugcugauuuugugccauaaccguauccagcagcucgaccugaagacuuuugaauuuaauaaagagcugagauaccucgauuuaucgaacaauaggcugaagucaguaaccugguaucuuuuggcggggcugcgguaccuagaccucagcuucaacgauuucgacacaaugcccauuugugaggaagcuggaaauaugagucaccuggagauccuuggucuguccggcgccaaaauacagaagucugauuuucaaaagaucagccauuugcaccucaacaccguguuccugggguuucgcacuuuaccucauuaugaagagggaucccugccaauucucaauacaaccaaacuucacaucguccugcccauggacacgaacuucuggguguugcuaagagauggcauuaagacuucaaaaauccuggagaugaccaauauagacgguaagagucaguuuguuagcuacgaaaugcagaggaaccucucucuggagcacgcaaaaacauccgugcuucuguugaauaaggucgaucuccugugggacgacuuauuccugauucuacaguuuguguggcauacuucaguagaacacuuccaaauccggaacguuaccuucgggggaaaggccuaucucgaucauaacagcuuugacuacaguaauacaauuaugcgcaccaucaaacuggagcacgugcacuuccgagucuuuuacauccagcaggauaagauuuaucuuuugcugacgaaaauggacauagaaaaccucacuaucucuaaugcucagaugccucauaugcuguucccaaacuaccccacaaaguuucaauaucuuaauuucgcaaacaauauucugaccgaugaguuguuuaaaagaacucuccagcugccucacuuaaagacacugauccuaaacggcaauaaacucgagacccugucccuugugagcugcuucgccaacaauacgccauuggaacaucuggaccucucgcagaaccuguuacaacacaagaaugaugagaacuguucuuggccggaaaccguggucaauaugaaccuguccuacaacaaacuuucagacaguguuuuuaggugcuugcccaagagcauacagauucucgaucugaauaacaaucagauccagacagugccuaaggagacuauccaucuaauggcucugcgggaacucaacauugccuucaauuuucugaccgaccuuccaggcuguucccacuucucucguuugagcguacugaacaucgagaugaauuuuauuuuaucacccagucucgauuucgugcaauccugccaggaggucaaaacacugaacgcggggcgcaauccuuucagauguacuugcgaacuuaagaacuuuauacagcuggagaccuauagcgaagugaugaugguuggauggucugacucauacacaugugaguauccauugaaucucagggguacccggcugaaagacgugcaccuacaugaacugaguugcaacacugcacuccugaucgucacgauugugguaaucaugcuuguuuugggccuggccguggcuuucugcuguuuacacuuugaucuccccugguaccugcgaaugcuugggcagugcacacaaaccuggcaucgcgucagaaagacuacccaggagcagcugaagaggaaugugcgguuccacgccuuuaucagcuacuccgagcacgacucucuaugggucaaaaacgaacucauuccgaaucuggagaaggaagauggaucgauauugaucugucuguaugagagcuacuucgacccuggcaaauccauuucagagaacaucgugaguuuuauugaaaagucuuauaaaagcaucuucguuuuaucccccaacuuugugcagaaugaguggugccauuacgaguucuauuuugcacaccauaaccucuuccacgaaaauucagaucauauaauccugauucuucuggaaccaaucccuuuuuacuguauucccacacgcuaucacaaguugaaggcucuccuggagaaaaaggccuaccuagaguggccaaaagacagaaggaagugcggucuguucugggcgaaccuucgugccgcaaucaauguaaacguccucgcuacccgggaaauguacgagcugcaaacuuucacagaauugaaugaggaaagccgagggucuacgauaucccugaugagaaccgauuguuuauga

SEQ ID NO: 9492 - RNA, 2436 nt, Artificial Sequence
  derived and/or modified sequence opt4 from TLR10__Homo_sapiens__AAY78487
augagacugaucagaaacaucuacaucuucugcagcaucgugaugaccgccgagggcgacgcccccgagcugcccgaggagagagagcugaugaccaacugcagcaacaugagccugagaaaggugcccgccgaccugacccccgccaccaccacccuggaccugagcuacaaccugcuguuccagcugcagagcagcgacuuccacagcgugagcaagcugagagugcugauccugugccacaacagaauccagcagcuggaccugaagaccuucgaguucaacaaggagcugagauaccuggaccugagcaacaacagacugaagagcgugaccugguaccugcuggccggccugagauaccuggaccugagcuucaacgacuucgacaccaugcccaucugcgaggaggccggcaacaugagccaccuggagauccugggccugagcggcgccaagauccagaagagcgacuuccagaagaucagccaccugcaccugaacaccguguuccugggcuucagaacccugccccacuacgaggagggcagccugcccauccugaacaccaccaagcugcacaucgugcugcccauggacaccaacuucugggugcugcugagagacggcaucaagaccagcaagauccuggagaugaccaacaucgacggcaagagccaguucgugagcuacgagaugcagagaaaccugagccuggagcacgccaagaccagcgugcugcugcugaacaagguggaccugcugugggacgaccuguuccugauccugcaguucguguggcacaccagcguggagcacuuccagaucagaaacgugaccuucggcggcaaggccuaccuggaccacaacagcuucgacuacagcaacaccaucaugagaaccaucaagcuggagcacgugcacuucagaguguucuacauccagcaggacaagaucuaccugcugcugaccaagauggacaucgagaaccugaccaucagcaacgcccagaugccccacaugcuguuccccaacuaccccaccaaguuccaguaccugaacuucgccaacaacauccugaccgacgagcuguucaagagaacccugcagcugccccaccugaagacccugauccugaacggcaacaagcuggagacccugagccuggugagcugcuucgccaacaacaccccccuggagcaccuggaccugagccagaaccugcugcagcacaagaacgacgagaacugcagcuggcccgagaccguggugaacaugaaccugagcuacaacaagcugagcgacagcguguucagaugccugcccaagagcauccagauccuggaccugaacaacaaccagauccagaccgugcccaaggagaccauccaccugauggcccugagagagcugaacaucgccuucaacuuccugaccgaccugcccggcugcagccacuucagcagacugagcgugcugaacaucgagaugaacuucauccugagccccagccuggacuucgugcagagcugccaggaggugaagacccugaacgccggcagaaaccccuucagaugcaccugcgagcugaagaacuucauccagcuggagaccuacagcgaggugaugauggugggcuggagcgacagcuacaccugcgaguacccccugaaccugagaggcaccagacugaaggacgugcaccugcacgagcugagcugcaacaccgcccugcugaucgugaccaucguggugaucaugcuggugcugggccuggccguggccuucugcugccugcacuucgaccugcccugguaccugagaaugcugggccagugcacccagaccuggcacagagugagaaagaccacccaggagcagcugaagagaaacgugagauuccacgccuucaucagcuacagcgagcacgacagccugugggugaagaacgagcugauccccaaccuggagaaggaggacggcagcauccugaucugccuguacgagagcuacuucgaccccggcaagagcaucagcgagaacaucgugagcuucaucgagaagagcuacaagagcaucuucgugcugagccccaacuucgugcagaacgaguggugccacuacgaguucuacuucgcccaccacaaccuguuccacgagaacagcgaccacaucauccugauccugcuggagcccauccccuucuacugcauccccaccagauaccacaagcugaaggcccugcuggagaagaaggccuaccuggaguggcccaaggacagaagaaagugcggccuguucugggccaaccugagagccgccaucaacgugaacgugcuggccaccagagagauguacgagcugcagaccuucaccgagcugaacgaggagagcagaggcagcaccaucagccugaugagaaccgacugccuguga

SEQ ID NO: 9493 - RNA, 2436 nt, Artificial Sequence
  derived and/or modified sequence opt5 from TLR10__Homo_sapiens__AAY78487
augagacugauccggaacauuuacaucuucugcagcauugugaugaccgccgagggcgacgcucccgaacucccugaggaacgcgagcugaugacaaauuguuccaacaugucucuuagaaaggucccggccgaucugacgcccgcgaccacaacccucgaccugagcuauaaucuucuguuucagcuccaauccucugauuuccacagcguuuccaaacugcgggugcugauccucugccauaaccgcauucagcagcuggaccuuaagacauuugaguucaauaaagagcugagauaccucgaucugucuaacaaucggcuuaagagcgugaccugguaucugcucgcugggcugcgcuaccuggaccucuccuuuaacgauuucgacacaaugccuaucugugaggaagccggaaauaugagccaccuggagauccuuggccugucuggggccaaaauucagaaguccgauuuucaaaagaucagccaucuccaccugaacaccgucuuccuuggauuuagaacgcugccccauuaugaagagggcucucucccuauucugaauaccacaaaacugcacaucgugcuccccauggacaccaacuucuggguucugcuucgggaugggauuaagacauccaaaauccuggagaugaccaauauugacggaaagagccaguuugugucuuacgaaaugcagcgcaaccucucccuggagcacgcuaaaacgagcguccuucugcucaauaagguggaucugcugugggacgaccucuuccugauccuucaguuuguuuggcauacauccguggaacacuuccaaaucagaaacgucaccuucggcggcaaggccuaucuggaucauaacucuuuugacuacagcaauacaauuaugcggaccaucaaacucgagcacgugcacuuccgcguguuuuacauucagcaggauaagaucuaucugcugcuuaccaaaauggacauugaaaaccucacaaucuccaaugcucagaugccucauaugcuguucccgaacuaccccacgaaguuucaauaucugaauuucgccaacaauauccucaccgaugagcuguuuaaaagaacacuucagcugccucaccucaagacccugauucugaacgggaauaaacuugagacacucagccuggucucuugcuucgcgaacaauacgccccuggaacaucucgaccugucccagaaccuucugcaacacaagaaugaugagaacuguagcuggccugaaaccguugugaauaugaaccucucuuacaacaagcugagcgacuccguguuucggugccugcccaaaucuauccagauucuugaucucaauaacaaucagauccagacagucccgaaggagaccauucaucugauggcccugcgcgaacucaacaucgcuuucaauuuucugaccgaccuuccuggauguagccacuucuccagacugagcgugcucaacaucgagaugaauuuuauucugucucccucccuggauuucguucaaagcugccaggaggugaaaacacuuaacgccggccggaauccuuucagauguaccugcgaacucaagaacuuuauccagcuggagacauauucugaagucaugaugguggggugguccgacagcuacacgugugaguauccccugaaucuccgcggaacccggcugaaagacguucaccuucaugaacuguccugcaacacagcucuccugauugugaccaucgucgugauuaugcugguccuuggccuggccguggcguucugcugucuccacuuugaucugcccugguaccucagaaugcuggggcagugcacacaaaccuggcaucgcguucggaagacgacccaggagcagcuuaagagaaaugugcgcuuccacgccuuuaucucuuacagcgagcacgacucccugugggucaaaaacgaacucauuccuaaucuggagaaggaagauggaucuauccugaucugucuuuaugagagcuacuucgacccgggcaaauccauuagcgagaacaucgugucuuuuauugaaaaguccuauaaaagcaucuucguucugucucccaacuuugugcagaaugaguggugccauuacgaguucuauuuugcucaccauaaccucuuccacgaaaauuccgaucauauuauccugauccuccuggaaccuauucccuuuuacuguaucccuacacgguaucacaaacuuaaggcccugcucgaaaagaaggcuuaccuggaguggcccaaagacagacgcaagugcggccuguucugggccaaccuucgggccgcuauuaaugucaacgugcuggcgaccagagaaauguacgagcuccaaacauucaccgaacugaaugaggaaagccgcgggucuacgaucagccucaugcggacagauugucuguga

SEQ ID NO: 9494 - protein, 811 aa, Artificial Sequence [sequence omitted]

SEQ ID NO: 9495 - RNA, 2436 nt, Artificial Sequence
  TLR10__Homo_sapiens__AAY78488
augagacucaucagaaacauuuacauauuuuguaguauaguuaugacagcagagggugaugcuccagagcugccagaagaaagggaacugaugaccaacugcuccaacaugucucuaagaaagguucccgcagacuugaccccagccacaacaacacuggauuuauccuauaaccuccuuuuucaacuccagaguucagauuuucauucugucuccaaacugagaguuuugauucuaugccauaacagaauucaacagcuggaucucaaaaccuuugaauucaacaaggaguuaagauauuuagauuugucuaauaacagacugaagaguguaacuugguauuuacuggcaggucucagguauuuagaucuuucuuuuaaugacuuugacaccaugccuaucugugaggaagcuggcaacaugucacaccuggaaauccuagguuugaguggggcaaaaauacaaaaaucagauuuccagaaaauuucucaucugcaucuaaauacugucuucuuaggauucagaacucuuccucauuaugaagaagguagccugcccaucuuaaacacaacaaaacugcacauuguuuuaccaauggacacaaauuucuggguucuuuugcgugauggaaucaagacuucaaaaauauuagaaaugacaaauauagauggcaaaagccaauuuguaaguuaugaaaugcaacgaaaucuuaguuuagaacaugcuaagacaucgguucuauugcuuaauaaaguugauuuacucugggacgaccuuuuccuuaucuuacaauuuguuuggcauacaucaguggaacacuuucagauccgaaaugugacuuuuggugguaaggcuuaucuugaccacaauucauuugacuacucaaauacuauaaugagaacuauaaaauuggagcauguacauuucagaguguuuuacauucaacaggauaaaaucuauuugcuuuugaccaaaacggacauagaaaaccugacaauaucaaaugcacaaaugccacacaugcuuuucccuaauuauccuacgaaauuccaauauuuaaauuuugccaauaauaucuuaacagacgaguuguuuaaaagaacucuccaacugccucacuugaaaacucucauuuugaauggcaauaaacuggagacacuuucuuuaguaaguugcuuugcuaacaacacacccuuggaacacuuggaucugagucaaaaucuauuacaacauaaaaaugaugaaaauugcucauggccagaaacuguggucaauaugaaucugucauacaauaaauugucugauucugucuucaggugcuugcccaaaaguauucaaauacuugaccuaaauaauaaccaaauccaaacuguaccuaaagagacuauucaucugauggccuuacgagaacuaaauauugcauuuaauuuucuaacugaucucccuggaugcagucauuucaguagacuuucaguucugaacauugaaaugaacuucauucucagcccaucucuggauuuuguucagagcugccaggaaguuaaaacucuaaaugcgggaagaaauccauuccgguguaccugugaauuaaaaaauuucauucagcuugaaacauauucagaggucaugaugguuggauggucagauucauacaccugugaauacccuuuaaaccuaaggggaacuagguuaaaagacguucaucuccacgaauuaucuugcaacacagcucuguugauugucaccauugugguuauuaugcuaguucugggguuggcuguggccuucugcugucuccacuuugaucugcccugguaucucaggaugcuaggucaaugcacacaaacauggcacaggguuaggaaaacaacccaagaacaacucaagagaaauguccgauuccacgcauuuauuucauacagugaacaugauucucugugggugaagaaugaauugauccccaaucuagagaaggaagaugguucuaucuugauuugccuuuaugaaagcuacuuugacccuggcaaaagcauuagugaaaauauuguaagcuucauugagaaaagcuauaaguccaucuuuguuuugucucccaacuuuguccagaaugaguggugccauuaugaauucuacuuugcccaccacaaucucuuccaugaaaauucugaucacauaauucuuaucuuacuggaacccauuccauucuauugcauucccaccagguaucauaaacugaaagcucuccuggaaaaaaaagcauacuuggaauggcccaaggauaggcguaaaugugggcuuuucugggcaaaccuucgagcugcuauuaauguuaauguauuagccaccagagaaauguaugaacugcagacauucacagaguuaaaugaagagucucgagguucuacaaucucucugaugagaacagacugucuauaa

SEQ ID NO: 9496 - RNA, 2436 nt, Artificial Sequence
  derived and/or modified sequence opt1 from TLR10__Homo_sapiens__AAY78488
augcgccugauccggaacaucuacaucuucugcagcaucgugaugaccgccgagggcgacgcccccgagcucccggaggagcgcgagcugaugaccaacugcuccaacaugagccugcggaagguccccgcggaccucacgcccgccaccaccacccuggaccuguccuacaaccuccuguuccagcugcagagcuccgacuuccacagcguguccaagcuccgcgugcugauccugugccacaaccggauccagcagcucgaccugaagacguucgaguucaacaaggagcugcgcuaccucgaccugagcaacaaccggcugaaguccgucaccugguaccuccuggccgggcugcgcuaccucgaccugagcuucaacgacuucgacaccaugcccaucugcgaggaggccggcaacaugucccaccuggagauccucgggcugagcggcgccaagauccagaaguccgacuuccagaagaucagccaccuccaccugaacaccguguuccugggguuccggacgcugccgcacuacgaggagggcucccuccccauccugaacaccaccaagcugcacaucgugcuccccauggacaccaacuucuggguccugcugcgcgacggcaucaagacgagcaagauccucgagaugaccaacaucgacgggaagucccaguucgugagcuacgagaugcagcggaaccugucccuggagcacgcgaagaccagcgugcuccugcugaacaaggucgaccuccugugggacgaccuguuccucauccugcaguucguguggcacaccagcguggagcacuuccagauccgcaacgucacguucggcgggaaggccuaccuggaccacaacuccuucgacuacagcaacaccaucaugcggaccaucaagcucgagcacgugcacuuccgcguguucuacauccagcaggacaagaucuaccugcugcugaccaagacggacaucgagaaccucaccaucuccaacgcccagaugccccacaugcuguucccgaacuaccccaccaaguuccaguaccugaacuucgccaacaacauccucaccgacgagcuguucaagcggacgcugcagcucccccaccugaagacccugauccucaacggcaacaagcuggagacccugagccucgucuccugcuucgcgaacaacacgccccuggagcaccuggaccucagccagaaccugcugcagcacaagaacgacgagaacugcuccuggccggagaccguggugaacaugaaccucagcuacaacaagcuguccgacagcgucuuccgcugccugcccaaguccauccagauccucgaccugaacaacaaccagauccagaccgugcccaaggagaccauccaccugauggcccuccgggagcugaacaucgccuucaacuuccugaccgaccuccccgggugcagccacuucucccgccugagcgugcugaacaucgagaugaacuucauccucuccccgagccuggacuucguccaguccugccaggaggugaagacgcugaacgccggccggaaccccuuccgcugcacgugcgagcucaagaacuucauccagcuggagaccuacagcgaggugaugauggucggcugguccgacagcuacacgugcgaguacccccugaaccuccgggggacccgccugaaggacgugcaccuccacgagcugagcugcaacaccgcccugcugaucgucaccaucguggugaucaugcucguccugggccuggcgguggccuucugcugccuccacuucgaccugcccugguaccugcgcaugcucgggcagugcacccagaccuggcaccgggugcgcaagaccacccaggagcagcugaagcggaacguccgcuuccacgccuucaucuccuacagcgagcacgacucccugugggugaagaacgagcucaucccgaaccuggagaaggaggacggcagcauccugaucugccucuacgaguccuacuucgaccccggcaagagcaucuccgagaacaucgugagcuucaucgagaaguccuacaagagcaucuucguccugucccccaacuucgugcagaacgaguggugccacuacgaguucuacuucgcccaccacaaccuguuccacgagaacagcgaccacaucauccucauccugcuggagcccaucccguucuacugcauccccacccgguaccacaagcucaaggcccugcuggagaagaaggcguaccucgaguggcccaaggaccgccggaagugcgggcuguucugggccaaccugcgcgccgccaucaacgugaacguccucgccacccgggagauguacgagcugcagacguucaccgagcugaacgaggagucccgcggcagcaccaucucccucaugcggaccgacugccuguga

SEQ ID NO: 9497 - RNA, 2436 nt, Artificial Sequence
  derived and/or modified sequence opt2 from TLR10__Homo_sapiens__AAY78488
augcgccucauccgcaacaucuacaucuucugcuccaucgucaugaccgccgagggcgacgcccccgagcuccccgaggagcgcgagcucaugaccaacugcuccaacaugucccuccgcaagguccccgccgaccucacccccgccaccaccacccucgaccucuccuacaaccuccucuuccagcuccaguccuccgacuuccacuccgucuccaagcuccgcguccucauccucugccacaaccgcauccagcagcucgaccucaagaccuucgaguucaacaaggagcuccgcuaccucgaccucuccaacaaccgccucaaguccgucaccugguaccuccucgccggccuccgcuaccucgaccucuccuucaacgacuucgacaccaugcccaucugcgaggaggccggcaacaugucccaccucgagauccucggccucuccggcgccaagauccagaaguccgacuuccagaagaucucccaccuccaccucaacaccgucuuccucggcuuccgcacccucccccacuacgaggagggcucccuccccauccucaacaccaccaagcuccacaucguccuccccauggacaccaacuucuggguccuccuccgcgacggcaucaagaccuccaagauccucgagaugaccaacaucgacggcaagucccaguucgucuccuacgagaugcagcgcaaccucucccucgagcacgccaagaccuccguccuccuccucaacaaggucgaccuccucugggacgaccucuuccucauccuccaguucgucuggcacaccuccgucgagcacuuccagauccgcaacgucaccuucggcggcaaggccuaccucgaccacaacuccuucgacuacuccaacaccaucaugcgcaccaucaagcucgagcacguccacuuccgcgucuucuacauccagcaggacaagaucuaccuccuccucaccaagaccgacaucgagaaccucaccaucuccaacgcccagaugccccacaugcucuuccccaacuaccccaccaaguuccaguaccucaacuucgccaacaacauccucaccgacgagcucuucaagcgcacccuccagcucccccaccucaagacccucauccucaacggcaacaagcucgagacccucucccucgucuccugcuucgccaacaacaccccccucgagcaccucgaccucucccagaaccuccuccagcacaagaacgacgagaacugcuccuggcccgagaccgucgucaacaugaaccucuccuacaacaagcucuccgacuccgucuuccgcugccuccccaaguccauccagauccucgaccucaacaacaaccagauccagaccguccccaaggagaccauccaccucauggcccuccgcgagcucaacaucgccuucaacuuccucaccgaccuccccggcugcucccacuucucccgccucuccguccucaacaucgagaugaacuucauccucucccccucccucgacuucguccaguccugccaggaggucaagacccucaacgccggccgcaaccccuuccgcugcaccugcgagcucaagaacuucauccagcucgagaccuacuccgaggucaugauggucggcugguccgacuccuacaccugcgaguacccccucaaccuccgcggcacccgccucaaggacguccaccuccacgagcucuccugcaacaccgcccuccucaucgucaccaucgucgucaucaugcucguccucggccucgccgucgccuucugcugccuccacuucgaccuccccugguaccuccgcaugcucggccagugcacccagaccuggcaccgcguccgcaagaccacccaggagcagcucaagcgcaacguccgcuuccacgccuucaucuccuacuccgagcacgacucccucugggucaagaacgagcucauccccaaccucgagaaggaggacggcuccauccucaucugccucuacgaguccuacuucgaccccggcaaguccaucuccgagaacaucgucuccuucaucgagaaguccuacaaguccaucuucguccucucccccaacuucguccagaacgaguggugccacuacgaguucuacuucgcccaccacaaccucuuccacgagaacuccgaccacaucauccucauccuccucgagcccauccccuucuacugcauccccacccgcuaccacaagcucaaggcccuccucgagaagaaggccuaccucgaguggcccaaggaccgccgcaagugcggccucuucugggccaaccuccgcgccgccaucaacgucaacguccucgccacccgcgagauguacgagcuccagaccuucaccgagcucaacgaggagucccgcggcuccaccaucucccucaugcgcaccgacugccucuga

SEQ ID NO: 9498 - RNA, 2436 nt, Artificial Sequence
  derived and/or modified sequence opt3 from TLR10__Homo_sapiens__AAY78488
augagacugaucaggaacauuuacauauucugcagcaucgugaugaccgccgagggcgacgcucccgaacucccugaggaacgggagcuuaugacaaauuguuccaacaugucucugcgcaaggucccagcagauuugacuccggccacgaccacauuagaccugucauauaaucuacucuuucagcugcaaaguagcgauuuccacuccguuucuaaacuucgagugcugauuuugugccauaaccguauccagcagcucgaccugaagacuuuugaauuuaauaaagagcugagauaccucgauuuaucgaacaauaggcugaagucaguaaccugguaucuuuuggcggggcugcgguaccuagaccucagcuucaacgauuucgacacaaugcccauuugugaggaagcuggaaauaugagucaccuggagauccuuggucuguccggcgccaaaauacagaagucugauuuucaaaagaucagccauuugcaccucaacaccguguuccugggguuucgcacuuuaccucauuaugaagagggaucccugccaauucucaauacaaccaaacuucacaucguccugcccauggacacgaacuucuggguguugcuaagagauggcauuaagacuucaaaaauccuggagaugaccaauauagacgguaagagucaguuuguuagcuacgaaaugcagaggaaccucucucuggagcacgcaaaaacauccgugcuucuguugaauaaggucgaucuccugugggacgacuuauuccugauucuacaguuuguguggcauacuucaguagaacacuuccaaauccggaacguuaccuucgggggaaaggccuaucucgaucauaacagcuuugacuacaguaauacaauuaugcgcaccaucaaacuggagcacgugcacuuccgagucuuuuacauccagcaggauaagauuuaucuuuugcugacgaaaacugacauagaaaaccucacaaucucuaaugcucagaugccucauaugcuguucccaaacuaccccaccaaguuucaauaucuuaauuucgcaaacaauauucugacugaugaguuguuuaaaagaacacuccagcugccucacuuaaagacccugauccuaaacggcaauaaacucgagacgcugucccuugugagcugcuucgccaacaauaccccauuggaacaucuggaccucucgcagaaccuguuacaacacaagaaugaugagaacuguucuuggccggaaacaguggucaauaugaaccuguccuacaacaaacuuucagacaguguuuuuaggugcuugcccaagagcauacagauucucgaucugaauaacaaucagauccagacugugccuaaggagaccauccaucuaauggcucugcgggaacucaacauugccuucaauuuucugacagaccuuccaggcuguucccacuucucucguuugagcguacugaacaucgagaugaauuuuauuuuaucacccagucucgauuucgugcaauccugccaggaggucaaaacucugaacgcggggcgcaauccuuucagauguaccugcgaacuuaagaacuuuauacagcuggagacauauagcgaagugaugaugguuggauggucugacucauacaccugugaguauccauugaaucucagggguacucggcugaaagacgugcaccuacaugaacugaguugcaacacggcacuccugaucgucacaauugugguaaucaugcuuguuuugggccuggccguggcuuucugcuguuuacacuuugaucuccccugguaccugcgaaugcuugggcagugcacccaaacuuggcaucgcgucagaaagaccacacaggagcagcugaagaggaaugugcgguuccacgccuuuaucagcuacuccgagcacgacucucuaugggucaaaaacgaacucauuccgaaucuggagaaggaagauggaucgauauugaucugucuguaugagagcuacuucgacccuggcaaauccauuucagagaacaucgugaguuuuauugaaaagucuuauaaaagcaucuucguuuuaucccccaacuuugugcagaaugaguggugccauuacgaguucuauuuugcacaccauaaccucuuccacgaaaauucagaucauauaauccugauucuucuggaaccaaucccuuuuuacuguauucccacccgcuaucacaaguugaaggcucuccuggagaaaaaggccuaccuagaguggccaaaagacagaaggaagugcggucuguucugggcgaaccuucgugccgcaaucaauguaaacguccucgcuacucgggaaauguacgagcugcaaacauucacggaauugaaugaggaaagccgagggucuaccauaucccugaugagaacugauuguuuauga

SEQ ID NO: 9499 - RNA, 2436 nt, Artificial Sequence
  derived and/or modified sequence opt4 from TLR10__Homo_sapiens__AAY78488
augagacugaucagaaacaucuacaucuucugcagcaucgugaugaccgccgagggcgacgcccccgagcugcccgaggagagagagcugaugaccaacugcagcaacaugagccugagaaaggugcccgccgaccugacccccgccaccaccacccuggaccugagcuacaaccugcuguuccagcugcagagcagcgacuuccacagcgugagcaagcugagagugcugauccugugccacaacagaauccagcagcuggaccugaagaccuucgaguucaacaaggagcugagauaccuggaccugagcaacaacagacugaagagcgugaccugguaccugcuggccggccugagauaccuggaccugagcuucaacgacuucgacaccaugcccaucugcgaggaggccggcaacaugagccaccuggagauccugggccugagcggcgccaagauccagaagagcgacuuccagaagaucagccaccugcaccugaacaccguguuccugggcuucagaacccugccccacuacgaggagggcagccugcccauccugaacaccaccaagcugcacaucgugcugcccauggacaccaacuucugggugcugcugagagacggcaucaagaccagcaagauccuggagaugaccaacaucgacggcaagagccaguucgugagcuacgagaugcagagaaaccugagccuggagcacgccaagaccagcgugcugcugcugaacaagguggaccugcugugggacgaccuguuccugauccugcaguucguguggcacaccagcguggagcacuuccagaucagaaacgugaccuucggcggcaaggccuaccuggaccacaacagcuucgacuacagcaacaccaucaugagaaccaucaagcuggagcacgugcacuucagaguguucuacauccagcaggacaagaucuaccugcugcugaccaagaccgacaucgagaaccugaccaucagcaacgcccagaugccccacaugcuguuccccaacuaccccaccaaguuccaguaccugaacuucgccaacaacauccugaccgacgagcuguucaagagaacccugcagcugccccaccugaagacccugauccugaacggcaacaagcuggagacccugagccuggugagcugcuucgccaacaacaccccccuggagcaccuggaccugagccagaaccugcugcagcacaagaacgacgagaacugcagcuggcccgagaccguggugaacaugaaccugagcuacaacaagcugagcgacagcguguucagaugccugcccaagagcauccagauccuggaccugaacaacaaccagauccagaccgugcccaaggagaccauccaccugauggcccugagagagcugaacaucgccuucaacuuccugaccgaccugcccggcugcagccacuucagcagacugagcgugcugaacaucgagaugaacuucauccugagccccagccuggacuucgugcagagcugccaggaggugaagacccugaacgccggcagaaaccccuucagaugcaccugcgagcugaagaacuucauccagcuggagaccuacagcgaggugaugauggugggcuggagcgacagcuacaccugcgaguacccccugaaccugagaggcaccagacugaaggacgugcaccugcacgagcugagcugcaacaccgcccugcugaucgugaccaucguggugaucaugcuggugcugggccuggccguggccuucugcugccugcacuucgaccugcccugguaccugagaaugcugggccagugcacccagaccuggcacagagugagaaagaccacccaggagcagcugaagagaaacgugagauuccacgccuucaucagcuacagcgagcacgacagccugugggugaagaacgagcugauccccaaccuggagaaggaggacggcagcauccugaucugccuguacgagagcuacuucgaccccggcaagagcaucagcgagaacaucgugagcuucaucgagaagagcuacaagagcaucuucgugcugagccccaacuucgugcagaacgaguggugccacuacgaguucuacuucgcccaccacaaccuguuccacgagaacagcgaccacaucauccugauccugcuggagcccauccccuucuacugcauccccaccagauaccacaagcugaaggcccugcuggagaagaaggccuaccuggaguggcccaaggacagaagaaagugcggccuguucugggccaaccugagagccgccaucaacgugaacgugcuggccaccagagagauguacgagcugcagaccuucaccgagcugaacgaggagagcagaggcagcaccaucagccugaugagaaccgacugccuguga

SEQ ID NO: 9500 - RNA, 2436 nt, Artificial Sequence
  derived and/or modified sequence opt5 from TLR10__Homo_sapiens__AAY78488
augagacugauccggaacauuuacaucuucugcagcauugugaugaccgccgagggcgacgcucccgaacucccugaggaacgcgagcugaugacaaauuguuccaacaugucucuuagaaaggucccggccgaucugacgcccgcgaccacaacccucgaccugagcuauaaucuucuguuucagcuccaauccucugauuuccacagcguuuccaaacugcgggugcugauccucugccauaaccgcauucagcagcuggaccuuaagacauuugaguucaauaaagagcugagauaccucgaucugucuaacaaucggcuuaagagcgugaccugguaucugcucgcugggcugcgcuaccuggaccucuccuuuaacgauuucgacacaaugccuaucugugaggaagccggaaauaugagccaccuggagauccuuggccugucuggggccaaaauucagaaguccgauuuucaaaagaucagccaucuccaccugaacaccgucuuccuuggauuuagaacgcugccccauuaugaagagggcucucucccuauucugaauaccacaaaacugcacaucgugcuccccauggacaccaacuucuggguucugcuucgggaugggauuaagacauccaaaauccuggagaugaccaauauugacggaaagagccaguuugugucuuacgaaaugcagcgcaaccucucccuggagcacgcuaaaacgagcguccuucugcucaauaagguggaucugcugugggacgaccucuuccugauccuucaguuuguuuggcauacauccguggaacacuuccaaaucagaaacgucaccuucggcggcaaggccuaucuggaucauaacucuuuugacuacagcaauacaauuaugcggaccaucaaacucgagcacgugcacuuccgcguguuuuacauucagcaggauaagaucuaucugcugcuuaccaaaacagacauugaaaaccucacgaucuccaaugcucagaugccucauaugcuguucccgaacuaccccaccaaguuucaauaucugaauuucgccaacaauauccucacagaugagcuguuuaaaagaacccuucagcugccucaccucaagacacugauucugaacgggaauaaacuugagacccucagccuggucucuugcuucgcgaacaauacgccccuggaacaucucgaccugucccagaaccuucugcaacacaagaaugaugagaacuguagcuggccugaaacaguugugaauaugaaccucucuuacaacaagcugagcgacuccguguuucggugccugcccaaaucuauccagauucuugaucucaauaacaaucagauccagaccgucccgaaggagaccauucaucugauggcccugcgcgaacucaacaucgcuuucaauuuucugacagaccuuccuggauguagccacuucuccagacugagcgugcucaacaucgagaugaauuuuauucugucucccucccuggauuucguucaaagcugccaggaggugaaaacccuuaacgccggccggaauccuuucagauguacaugcgaacucaagaacuuuauccagcuggagacguauucugaagucaugaugguggggugguccgacagcuacaccugugaguauccccugaaucuccgcggaacacggcugaaagacguucaccuucaugaacuguccugcaacaccgcucuccugauugugacaaucgucgugauuaugcugguccuuggccuggccguggcguucugcugucuccacuuugaucugcccugguaccucagaaugcuggggcagugcacccaaacguggcaucgcguucggaagaccacacaggagcagcuuaagagaaaugugcgcuuccacgccuuuaucucuuacagcgagcacgacucccugugggucaaaaacgaacucauuccuaaucuggagaaggaagauggaucuauccugaucugucuuuaugagagcuacuucgacccgggcaaauccauuagcgagaacaucgugucuuuuauugaaaaguccuauaaaagcaucuucguucugucucccaacuuugugcagaaugaguggugccauuacgaguucuauuuugcucaccauaaccucuuccacgaaaauuccgaucauauuauccugauccuccuggaaccuauucccuuuuacuguaucccuacccgguaucacaaacuuaaggcccugcucgaaaagaaggcuuaccuggaguggcccaaagacagacgcaagugcggccuguucugggccaaccuucgggccgcuauuaaugucaacgugcuggcgacaagagaaauguacgagcuccaaaccuucacggaacugaaugaggaaagccgcgggucuacaaucagccucaugcggaccgauugucuguga

SEQ ID NO: 9501 - protein, 811 aa, Artificial Sequence; identical to SEQ ID NO: 9438
  TLR10__Homo_sapiens__Q9BXR5

SEQ ID NO: 9502 - RNA, 2436 nt, Artificial Sequence; identical to SEQ ID NO: 9439
  TLR10__Homo_sapiens__AAH89406

SEQ ID NO: 9503 - RNA, 2436 nt, Artificial Sequence; identical to SEQ ID NO: 9440
  derived and/or modified sequence opt1 from TLR10__Homo_sapiens__AAH89406

SEQ ID NO: 9504 - RNA, 2436 nt, Artificial Sequence; identical to SEQ ID NO: 9441
  derived and/or modified sequence opt2 from TLR10__Homo_sapiens__AAH89406

SEQ ID NO: 9505 - RNA, 2436 nt, Artificial Sequence; identical to SEQ ID NO: 9442
  derived and/or modified sequence opt3 from TLR10__Homo_sapiens__AAH89406

SEQ ID NO: 9506 - RNA, 2436 nt, Artificial Sequence; identical to SEQ ID NO: 9443
  derived and/or modified sequence opt4 from TLR10__Homo_sapiens__AAH89406

SEQ ID NO: 9507 - RNA, 2436 nt, Artificial Sequence; identical to SEQ ID NO: 9444
  derived and/or modified sequence opt5 from TLR10__Homo_sapiens__AAH89406

SEQ ID NO: 9508 - protein, 786 aa, Artificial Sequence
  TLR1__Homo_sapiens__D1CS34
MTSIFHFAIIFMLILQIRIQLSEESEFLVDRSKNGLIHVPKDLSQKTTILNISQNYISELWTSDILSLSKLRILIISHNRIQYLDISVFKFNQELEYLDLSHNKLVKISCHPTVNLKHLDLSFNAFDALPICKEFGNMSQLKFLGLSTTHLEKSSVLPIAHLNISKVLLVLGETYGEKEDPEGLQDFNTESLHIVFPTNKEFHFILDVSVKTVANLELSNIKCVLEDNKCSYFLSILAKLQTNPKLSSLTLNNIETTWNSFIRILQLVWHTTVWYFSISNVKLQGQLDFRDFDYSGTSLKALSIHQVVSDVFGFPQSYIYEIFSNMNIKNFTVSGTRMVHMLCPSKISPFLHLDFSNNLLTDTVFENCGHLTELETLILQMNQLKELSKIAEMTTQMKSLQQLDISQNSVSYDEKKGDCSWTKSLLSLNMSSNILTDTIFRCLPPRIKVLDLHSNKIKSIPKQVVKLEALQELNVAFNSLTDLPGCGSFSSLSVLIIDHNSVSHPSADFFQSCQKMRSIKAGDNPFQCTCELGEFVKNIDQVSSEVLEGWPDSYKCDYPESYRGTLLKDFHMSELSCNITLLIVTIVATMLVLAVTVTSLCIYLDLPWYLRMVCQWTQTRRRARNIPLEELQRNLQFHAFISYSGHDSFWVKNELLPNLEKEGMQICLHERNFVPGKSIVENIITCIEKSYKSIFVLSPNFVQSEWCHYELYFAHHNLFHEGSNSLILILLEPIPQYSIPSSYHKLKSLMARRTYLEWPKEKSKRGLFWANLRAAINIKLTEQAKK

SEQ ID NO: 9509 - RNA, 2361 nt, Artificial Sequence
  TLR1__Homo_sapiens__AAY85633
augacuagcaucuuccauuuugccauuaucuucauguuaauacuucagaucagaauacaauuaucugaagaaagugaauuuuuaguugauaggucaaaaaacggucucauccacguuccuaaagaccuaucccagaaaacaacaaucuuaaauauaucgcaaaauuauauaucugagcuuuggacuucugacaucuuaucacugucaaaacugaggauuuugauaauuucucauaauagaauccaguaucuugauaucaguguuuucaaauucaaccaggaauuggaauacuuggauuugucccacaacaaguuggugaagauuucuugccacccuacugugaaccucaagcacuuggaccugucauuuaaugcauuugaugcccugccuauaugcaaagaguuuggcaauaugucucaacuaaaauuucugggguugagcaccacacacuuagaaaaaucuagugugcugccaauugcucauuugaauaucagcaaggucuugcuggucuuaggagagacuuauggggaaaaagaagacccugagggccuucaagacuuuaacacugagagucugcacauuguguuccccacaaacaaagaauuccauuuuauuuuggaugugucagucaagacuguagcaaaucuggaacuaucuaauaucaaaugugugcuagaagauaacaaauguucuuacuuccuaaguauucuggcgaaacuucaaacaaauccaaaguuaucaagucuuaccuuaaacaacauugaaacaacuuggaauucuuucauuaggauccuccagcugguuuggcauacaacuguaugguauuucucaauuucaaacgugaagcuacagggucagcuggacuucagagauuuugauuauucuggcacuuccuugaaggccuugucuauacaccaaguugucagcgauguguucgguuuuccgcaaaguuauaucuaugaaaucuuuucgaauaugaacaucaaaaauuucacagugucugguacacgcaugguccacaugcuuugcccauccaaaauuagcccguuccugcauuuggauuuuuccaauaaucucuuaacagacacgguuuuugaaaauugugggcaccuuacugaguuggagacacuuauuuuacaaaugaaucaauuaaaagaacuuucaaaaauagcugaaaugacuacacagaugaagucucugcaacaauuggauauuagccagaauucuguaagcuaugaugaaaagaaaggagacuguucuuggacuaaaaguuuauuaaguuuaaauaugucuucaaauauacuuacugacacuauuuucagauguuuaccucccaggaucaagguacuugaucuucacagcaauaaaauaaagagcauuccuaaacaagucguaaaacuggaagcuuugcaagaacucaauguugcuuucaauucuuuaacugaccuuccuggauguggcagcuuuagcagccuuucuguauugaucauugaucacaauucaguuucccacccaucagcugauuucuuccagagcugccagaagaugaggucaauaaaagcaggggacaauccauuccaauguaccugugagcuaggagaauuugucaaaaauauagaccaaguaucaagugaaguguuagagggcuggccugauucuuauaagugugacuacccggaaaguuauagaggaacccuacuaaaggacuuucacaugucugaauuauccugcaacauaacucugcugaucgucaccaucguugccaccaugcugguguuggcugugacugugaccucccucugcaucuacuuggaucugcccugguaucucaggauggugugccaguggacccagacccggcgcagggccaggaacauacccuuagaagaacuccaaagaaaucuccaguuucaugcauuuauuucauauagugggcacgauucuuucugggugaagaaugaauuauugccaaaccuagagaaagaagguaugcagauuugccuucaugagagaaacuuuguuccuggcaagagcauuguggaaaauaucaucaccugcauugagaagaguuacaaguccaucuuuguuuugucucccaacuuuguccagagugaauggugccauuaugaacucuacuuugcccaucacaaucucuuucaugaaggaucuaauagcuuaauccugaucuugcuggaacccauuccgcaguacuccauuccuagcaguuaucacaagcucaaaagucucauggccaggaggacuuauuuggaauggcccaaggaaaagagcaaacguggccuuuuuugggcuaacuuaagggcagccauuaauauuaagcugacagagcaagcaaagaaauag

SEQ ID NO: 9510 - RNA, 2361 nt, Artificial Sequence
  derived and/or modified sequence opt1 from TLR1__Homo_sapiens__AAY85633
augaccagcaucuuccacuucgccaucaucuucaugcugauccuccagauccgcauccagcuguccgaggagagcgaguuccugguggaccgguccaagaacggccucauccacguccccaaggaccugagccagaagaccacgauccugaacaucucccagaacuacaucagcgagcucuggaccuccgacauccugagccuguccaagcuccgcauccugaucaucagccacaaccggauccaguaccuggacaucuccguguucaaguucaaccaggagcucgaguaccuggaccugagccacaacaagcucgugaagaucuccugccacccgaccgucaaccugaagcaccuggaccucagcuucaacgccuucgacgcgcugcccaucugcaaggaguucgggaacaugucccagcugaaguuccucggccugagcaccacgcaccuggagaaguccagcgugcuccccaucgcccaccugaacaucuccaaggugcugcucguccugggggagaccuacggcgagaaggaggaccccgaggggcugcaggacuucaacaccgagagccuccacaucguguucccgaccaacaaggaguuccacuucauccuggacgugagcgucaagacgguggccaaccuggagcucuccaacaucaagugcgugcuggaggacaacaagugcagcuacuuccuguccauccucgccaagcugcagaccaaccccaagcugagcucccucacccugaacaacaucgagaccacguggaacagcuucauccgcauccugcagcucgucuggcacaccaccgugugguacuucuccaucagcaacgugaagcugcagggccagcuggacuuccgggacuucgacuacuccggcaccagccucaaggcccuguccauccaccaggucgugagcgacguguucggguucccccaguccuacaucuacgagaucuucagcaacaugaacaucaagaacuucacggucuccggcacccgcauggugcacaugcugugccccagcaagaucuccccguuccuccaccuggacuucagcaacaaccugcugaccgacaccguguucgagaacugcgggcaccucacggagcuggagacccugauccuccagaugaaccagcugaaggagcuguccaagaucgcggagaugaccacccagaugaagucccuccagcagcuggacaucagccagaacagcgucagcuacgacgagaagaagggcgacugcuccuggaccaagagccugcucucccugaacaugagcuccaacauccugaccgacaccaucuuccggugccucccgccccgcaucaaggugcuggaccugcacagcaacaagaucaaguccauccccaagcaggucgugaagcucgaggcccugcaggagcugaacguggccuucaacagccucaccgaccugcccgggugcggcuccuucagcucccugagcguccucaucaucgaccacaacuccgugagccaccccuccgccgacuucuuccagagcugccagaagaugcggagcaucaaggcgggcgacaaccccuuccagugcacgugcgagcugggggaguucgugaagaacaucgaccaggucuccagcgaggugcuggagggcuggcccgacuccuacaagugcgacuacccggagagcuaccgcgggacccuccugaaggacuuccacauguccgagcugagcugcaacaucacccuccugaucgugaccaucgucgccacgaugcuggugcucgccgugaccgucaccucccugugcaucuaccuggaccuccccugguaccugcggauggugugccaguggacccagacgcgccggcgcgcccggaacaucccccuggaggagcuccagcgcaaccugcaguuccacgccuucaucagcuacuccggccacgacagcuucugggugaagaacgagcugcuccccaaccuggagaaggagggcaugcagaucugccugcacgagcggaacuucgucccggggaaguccaucguggagaacaucaucacgugcaucgagaaguccuacaagagcaucuucgugcucagccccaacuucguccaguccgaguggugccacuacgagcuguacuucgcgcaccacaaccuguuccacgagggcagcaacucccucauccugauccugcucgagcccaucccccaguacagcaucccguccagcuaccacaagcucaagagccugauggcccgccggaccuaccuggaguggcccaaggagaaguccaagcgcgggcuguucugggccaaccugcgggccgccaucaacaucaagcucaccgagcaggcgaagaaguga

SEQ ID NO: 9511 - RNA, 2361 nt, Artificial Sequence
  derived and/or modified sequence opt2 from TLR1__Homo_sapiens__AAY85633
augaccuccaucuuccacuucgccaucaucuucaugcucauccuccagauccgcauccagcucuccgaggaguccgaguuccucgucgaccgcuccaagaacggccucauccacguccccaaggaccucucccagaagaccaccauccucaacaucucccagaacuacaucuccgagcucuggaccuccgacauccucucccucuccaagcuccgcauccucaucaucucccacaaccgcauccaguaccucgacaucuccgucuucaaguucaaccaggagcucgaguaccucgaccucucccacaacaagcucgucaagaucuccugccaccccaccgucaaccucaagcaccucgaccucuccuucaacgccuucgacgcccuccccaucugcaaggaguucggcaacaugucccagcucaaguuccucggccucuccaccacccaccucgagaaguccuccguccuccccaucgcccaccucaacaucuccaagguccuccucguccucggcgagaccuacggcgagaaggaggaccccgagggccuccaggacuucaacaccgagucccuccacaucgucuuccccaccaacaaggaguuccacuucauccucgacgucuccgucaagaccgucgccaaccucgagcucuccaacaucaagugcguccucgaggacaacaagugcuccuacuuccucuccauccucgccaagcuccagaccaaccccaagcucuccucccucacccucaacaacaucgagaccaccuggaacuccuucauccgcauccuccagcucgucuggcacaccaccgucugguacuucuccaucuccaacgucaagcuccagggccagcucgacuuccgcgacuucgacuacuccggcaccucccucaaggcccucuccauccaccaggucgucuccgacgucuucggcuucccccaguccuacaucuacgagaucuucuccaacaugaacaucaagaacuucaccgucuccggcacccgcaugguccacaugcucugccccuccaagaucucccccuuccuccaccucgacuucuccaacaaccuccucaccgacaccgucuucgagaacugcggccaccucaccgagcucgagacccucauccuccagaugaaccagcucaaggagcucuccaagaucgccgagaugaccacccagaugaagucccuccagcagcucgacaucucccagaacuccgucuccuacgacgagaagaagggcgacugcuccuggaccaagucccuccucucccucaacauguccuccaacauccucaccgacaccaucuuccgcugccuccccccccgcaucaagguccucgaccuccacuccaacaagaucaaguccauccccaagcaggucgucaagcucgaggcccuccaggagcucaacgucgccuucaacucccucaccgaccuccccggcugcggcuccuucuccucccucuccguccucaucaucgaccacaacuccgucucccaccccuccgccgacuucuuccaguccugccagaagaugcgcuccaucaaggccggcgacaaccccuuccagugcaccugcgagcucggcgaguucgucaagaacaucgaccaggucuccuccgagguccucgagggcuggcccgacuccuacaagugcgacuaccccgaguccuaccgcggcacccuccucaaggacuuccacauguccgagcucuccugcaacaucacccuccucaucgucaccaucgucgccaccaugcucguccucgccgucaccgucaccucccucugcaucuaccucgaccuccccugguaccuccgcauggucugccaguggacccagacccgccgccgcgcccgcaacaucccccucgaggagcuccagcgcaaccuccaguuccacgccuucaucuccuacuccggccacgacuccuucugggucaagaacgagcuccuccccaaccucgagaaggagggcaugcagaucugccuccacgagcgcaacuucguccccggcaaguccaucgucgagaacaucaucaccugcaucgagaaguccuacaaguccaucuucguccucucccccaacuucguccaguccgaguggugccacuacgagcucuacuucgcccaccacaaccucuuccacgagggcuccaacucccucauccucauccuccucgagcccaucccccaguacuccauccccuccuccuaccacaagcucaagucccucauggcccgccgcaccuaccucgaguggcccaaggagaaguccaagcgcggccucuucugggccaaccuccgcgccgccaucaacaucaagcucaccgagcaggccaagaaguga

SEQ ID NO: 9512 - RNA, 2361 nt, Artificial Sequence
  derived and/or modified sequence opt3 from TLR1__Homo_sapiens__AAY85633
augaccagcaucuuccacuuugccauuauauucaugcugauccuccagauuagaauccaacuuuccgaggaaucugaguuucugguggacaggucaaagaacggcuugauucauguccccaaagauuuaagucagaagacaacuauccugaauauaagccagaacuacaucuccgaacuauggacgucugacauucucucgcugucaaaacuucggauccugauuaucagccacaaucgcauacaguauuuggauauuaguguuuucaaguuuaaccaagagcucgaauaccuggaccugucccauaauaaacucgugaagaucucuugccacccuaccguaaacuuaaagcaucuggaucuuagcuucaaugcuuuugacgcauugccaauuuguaaagaguucgggaacaugucccagcugaaguuucuaggacucucaacaacucaccuggagaaaaguagcgugcuuccgaucgcccaccugaauaucucuaaggucuugcucgugcugggugaaaccuauggcgagaaagaagaucccgagggguuacaggacuucaacacagagucccugcauauuguuuuuccuaccaauaaggaguuccacuuuauacucgaugugucagucaagacuguggcgaaccuugaacugagcaauaucaaaugcguauuggaagacaacaaguguaguuacuuccuaucuauucuggcuaaacuccagacaaauccaaagcuguccagccuuacccugaacaacaucgagacgacuuggaauagcuucauacgaauuuugcaacucguuuggcauaccacagugugguauuuuucuaucuccaacgucaaacugcagggacaguuagauuuccgugacuuugauuacucaggcacuucacugaaggcccuaagcauccaccaggugguguccgacgucuucgguuuuccccaaucuuauauuuacgaaaucuucagcaauaugaacauuaaaaauuuuaccguuucagggacaagaauggugcacaugcucugcccuaguaagauauccccauuccugcaucuugacuuuagcaacaauuugcugaccgauacgguauucgagaacuguggacaccucacugagcuggaaacacuuauccugcagaugaaucaguugaaggagcucucuaaaauugcagaaaugaccacucaaaugaagucacugcagcaguuagacaucagucagaacagcguguccuacgaugagaaaaagggcgacugcucuuggacaaaaucgcugcuaagccucaauauguccucaaacauccugaccgauacgauuuuuaggugucuucccccucggauaaaggucuuggaccugcauaguaauaagaucaaaucuauuccaaagcaagugguuaaacucgaagcccugcaggaguuaaacguggcuuucaauagccugaccgaucuuccgggcugcggguccuuuaguagcuugucuguccucaucauugaccacaacuccgugagucaucccagcgcagauuucuuccagucuugucagaagaugcgcuccaucaaagccggagacaacccuuuucaaugcacaugugagcugggugaguucguaaagaauauagaucagguuucaagugaagugcuagaaggcuggccagacagcuauaagugcgacuaccccgagucguauagagggacucugcucaaagauuuucacauguccgaacugucuugcaacaucacccuuuugauugucacaaucguggcuacuaugcuggucuuagccgugaccguuacaagccucuguauuuaccuggaccuuccuugguaucugaggauggugugccaguggacccagacucggcgccgagcgagaaauaucccauuggaggagcuccaaaggaaccugcaguuccacgcauuuauaucauacaguggacaugauuccuucuggguaaagaaugaacuacugcccaaccucgagaaagaaggcaugcagauuugucugcacgagcggaauuuugucccggguaagucuaucguggagaacauuaucacgugcauagaaaaaucguauaaguccaucuucguucuuucaccuaauuuugugcagagcgaguggugucauuacgaauuguacuucgcccaccacaaccuguuucaugaggggaguaauucuuuaauucucauccugcuugaacccauuccacaauauuccaucccuagcucguaccacaagcugaaaucacuaauggcucgucgcacauaucucgaguggcccaaggagaaaucuaagagaggacuguucugggccaacuugagggcagcuauaaauauuaaacugaccgaacaggccaagaaauga

SEQ ID NO: 9513 - RNA, 2361 nt, Artificial Sequence
  derived and/or modified sequence opt4 from TLR1__Homo_sapiens__AAY85633
augaccagcaucuuccacuucgccaucaucuucaugcugauccugcagaucagaauccagcugagcgaggagagcgaguuccugguggacagaagcaagaacggccugauccacgugcccaaggaccugagccagaagaccaccauccugaacaucagccagaacuacaucagcgagcuguggaccagcgacauccugagccugagcaagcugagaauccugaucaucagccacaacagaauccaguaccuggacaucagcguguucaaguucaaccaggagcuggaguaccuggaccugagccacaacaagcuggugaagaucagcugccaccccaccgugaaccugaagcaccuggaccugagcuucaacgccuucgacgcccugcccaucugcaaggaguucggcaacaugagccagcugaaguuccugggccugagcaccacccaccuggagaagagcagcgugcugcccaucgcccaccugaacaucagcaaggugcugcuggugcugggcgagaccuacggcgagaaggaggaccccgagggccugcaggacuucaacaccgagagccugcacaucguguuccccaccaacaaggaguuccacuucauccuggacgugagcgugaagaccguggccaaccuggagcugagcaacaucaagugcgugcuggaggacaacaagugcagcuacuuccugagcauccuggccaagcugcagaccaaccccaagcugagcagccugacccugaacaacaucgagaccaccuggaacagcuucaucagaauccugcagcugguguggcacaccaccgugugguacuucagcaucagcaacgugaagcugcagggccagcuggacuucagagacuucgacuacagcggcaccagccugaaggcccugagcauccaccagguggugagcgacguguucggcuucccccagagcuacaucuacgagaucuucagcaacaugaacaucaagaacuucaccgugagcggcaccagaauggugcacaugcugugccccagcaagaucagccccuuccugcaccuggacuucagcaacaaccugcugaccgacaccguguucgagaacugcggccaccugaccgagcuggagacccugauccugcagaugaaccagcugaaggagcugagcaagaucgccgagaugaccacccagaugaagagccugcagcagcuggacaucagccagaacagcgugagcuacgacgagaagaagggcgacugcagcuggaccaagagccugcugagccugaacaugagcagcaacauccugaccgacaccaucuucagaugccugccccccagaaucaaggugcuggaccugcacagcaacaagaucaagagcauccccaagcagguggugaagcuggaggcccugcaggagcugaacguggccuucaacagccugaccgaccugcccggcugcggcagcuucagcagccugagcgugcugaucaucgaccacaacagcgugagccaccccagcgccgacuucuuccagagcugccagaagaugagaagcaucaaggccggcgacaaccccuuccagugcaccugcgagcugggcgaguucgugaagaacaucgaccaggugagcagcgaggugcuggagggcuggcccgacagcuacaagugcgacuaccccgagagcuacagaggcacccugcugaaggacuuccacaugagcgagcugagcugcaacaucacccugcugaucgugaccaucguggccaccaugcuggugcuggccgugaccgugaccagccugugcaucuaccuggaccugcccugguaccugagaauggugugccaguggacccagaccagaagaagagccagaaacaucccccuggaggagcugcagagaaaccugcaguuccacgccuucaucagcuacagcggccacgacagcuucugggugaagaacgagcugcugcccaaccuggagaaggagggcaugcagaucugccugcacgagagaaacuucgugcccggcaagagcaucguggagaacaucaucaccugcaucgagaagagcuacaagagcaucuucgugcugagccccaacuucgugcagagcgaguggugccacuacgagcuguacuucgcccaccacaaccuguuccacgagggcagcaacagccugauccugauccugcuggagcccaucccccaguacagcauccccagcagcuaccacaagcugaagagccugauggccagaagaaccuaccuggaguggcccaaggagaagagcaagagaggccuguucugggccaaccugagagccgccaucaacaucaagcugaccgagcaggccaagaaguga

SEQ ID NO: 9514 - RNA, 2361 nt, Artificial Sequence
  derived and/or modified sequence opt5 from TLR1__Homo_sapiens__AAY85633
augaccagcaucuuccacuuugccauuaucuucaugcugauucuccagauccggauucaacuguccgaggaaucugaguuucuuguggacagaagcaagaacggccugauccauguccccaaagaucucucccagaagacaacgauccugaauauuucucagaacuacaucagcgaacuuuggaccuccgacauucugucucucagcaaacugcgcauccugauuaucucccacaauagaauccaguaucucgauauuagcguuuucaaguuuaaccaagagcuggaauaccuugaccugucucauaauaaacucgugaagaucuccugccacccuacagugaaccugaagcaucuugaucugagcuucaaugcuuuugacgcccucccgauuuguaaagaguucgggaacaugucucagcugaaguuucugggacucuccaccacacaccuggagaaaagcucuguccuucccaucgcgcaccugaauauuuccaaggugcuccugguucuuggcgaaaccuauggggagaaagaagauccugagggacugcaggacuucaacacagagagccuccauaucguguuucccaccaauaaggaguuccacuuuauucuggaugucuccgugaagacgguugcuaaccuggaacucucuaauaucaaaugcgugcuggaagacaacaaguguagcuacuuccuuuccauccuggccaaacuccagaccaauccuaagcugagcucucuuacacugaacaacauugagaccacauggaauagcuucauccggauucuccaacuggucuggcauaccacggugugguauuuuagcaucucuaacgugaaacugcagggccagcucgauuuccgcgacuuugauuacagcgggacaucccugaaggcccuuucuauucaccaggucguuagcgacguguucggauuuccccaauccuauaucuacgaaaucuucagcaauaugaacauuaaaaauuuuaccgugucuggcacaagaaugguccacaugcugugcccuuccaagaucagcccguuccuccaucuggacuuuucuaacaaucugcuuaccgauaccguguucgagaacuguggccaccucacagagcuggaaacgcugauucuccagaugaaucagcugaaggagcuuuccaaaaucgcugaaaugaccacacaaaugaagucccugcagcagcucgacauuucccagaacucuguuagcuacgaugagaaaaagggggacugcuccuggaccaaaucucugcugagccuuaauauguccagcaacauccucacagauaccauuuuucggugucugcccccucgcaucaaggugcuggaccuccauucuaauaagaucaaauccauucccaagcaagucgugaaacuggaagcccuucaggagcugaacguugcuuucaauagccucacggaucugccuggaugcggcucuuuuuccagccugucugugcuuaucauugaccacaacagcgucucccaucccagcgccgauuucuuccagucuugucagaagaugagauccaucaaagcgggggacaacccguuucaaugcacaugugagcucggagaguucgugaagaauauugaucaggucagcuccgaagugcuggaaggcuggccugacucuuauaagugcgacuaccccgagagcuaucgggggacccugcucaaagauuuucacauguccgaacugucuugcaacaucacccuucugaucguuacaauuguggccaccaugcucguccuggcugugacaguuacgagccuguguaucuaccuugaccucccuugguaucugcgcauggugugccaguggacccagacaagacggcgcgccagaaauauuccccuggaggagcuccaacggaaccugcaguuccacgcuuuuaucuccuacucuggacaugauagcuucugggucaagaaugaacuucugcccaaccucgagaaagaaggcaugcagauuugucugcacgagcgcaauuuugugccuggcaaguccaucguggagaacaucauuaccugcaucgaaaagagcuauaagucuauuuucguucuguccccgaauuuuguccagagcgaguggugucauuacgaacuuuacuucgcccaccacaaccuguuucaugaggggucuaauucccucauccugauucuccuggaacccaucccucaauauagcauccccucuuccuaccacaaacuuaaaagccugauggcgagacggacauaucucgaguggccuaaggagaaauccaagagaggacuguucugggccaaccugcgcgcugccauuaauaucaaacuuaccgaacaggcuaagaaauga

SEQ ID NO: 9515 - protein, 786 aa, Artificial Sequence [sequence omitted]

SEQ ID NO: 9516 - RNA, 2361 nt, Artificial Sequence
  TLR1__Homo_sapiens__AAY85634
augacuagcaucuuccauuuugccauuaucuucauguuaauacuucagaucagaauacaauuaucugaagaaagugaauuuuuaguugauaggucaaaaaacggucucauccacguuccuaaagaccuaucccagaaaacaacaaucuuaaauauaucgcaaaauuauauaucugagcuuuggacuucugacaucuuaucacugucaaaacugaggauuuugauaauuucucauaauagaauccaguaucuugauaucaguguuuucaaauucaaccaggaauuggaauacuuggauuugucccacaacaaguuggugaagauuucuugccacccuacugugaaccucaagcacuuggaccugucauuuaaugcauuugaugcccugccuauaugcaaagaguuuggcaauaugucucaacuaaaauuucugggguugagcaccacacacuuagaaaaaucuagugugcugccaauugcucauuugaauaucagcaaggucuugcuggucuuaggagagacuuauggggaaaaagaagacccugagggccuucaagacuuuaacacugagagucugcacauuguguuccccacaaacaaagaauuccauuuuauuuuggaugugucagucaagacuguagcaaaucuggaacuaucuaauaucaaaugugugcuagaagauaacaaauguucuuacuuccuaaguauucuggcgaaacuucaaacaaauccaaaguuaucaagucuuaccuuaaacaacauugaaacaacuuggaauucuuucauuaggauccuccagcugguuuggcauacaacuguaugguauuucucaauuucaaacgugaagcuacagggucagcuggacuucagagauuuugauuauucuggcacuuccuugaaggccuugucuauacaccaaguugucagcgauguguucgguuuuccgcaaaguuauaucuaugaaaucuuuucgaauaugaacaucaaaaauuucacagugucugguacacgcaugguccacaugcuuugcccauccaaaauuagcccguuccugcauuuggauuuuuccaauaaucucuuaacagacacgguuuuugaaaauugugggcaccuuacugaguuggagacacuuauuuuacaaaugaaucaauuaaaagaacuuucaaaaauagcugaaaugacuacacagaugaagucucugcaacaauuggauauuagccagaauucuguaagcuaugaugaaaagaaaggagacuguucuuggacuaaaaguuuauuaaguuuaaauaugucuucaaauauacuuacugacacuauuuucagauguuuaccucccaggaucaagguacuugaucuucacagcaauaaaauaaagagcauuccuaaacaagucguaaaacuggaagcuuugcaagaacucaauguugcuuucaauucuuuaacugaccuuccuggauguggcagcuuuagcagccuuucuguauugaucauugaucacaauucaguuucccacccaucagcugauuucuuccagagcugccagaagaugaggucaauaaaagcaggggacaauccauuccaauguaccugugagcuaggagaauuugucaaaaauauagaccaaguaucaagugaaguguuagagggcuggccugauucuuauaagugugacuacccggaaaguuauagaggaagccuacuaaaggacuuucacaugucugaauuauccugcaacauaacucugcugaucgucaccaucguugccaccaugcugguguuggcugugacugugaccucccucugcaucuacuuggaucugcccugguaucucaggauggugugccaguggacccagacccggcgcagggccaggaacauacccuuagaagaacuccaaagaaaucuccaguuucaugcauuuauuucauauagugggcacgauucuuucugggugaagaaugaauuauugccaaaccuagagaaagaagguaugcagauuugccuucaugagagaaacuuuguuccuggcaagagcauuguggaaaauaucaucaccugcauugagaagaguuacaaguccaucuuuguuuugucucccaacuuuguccagagugaauggugccauuaugaacucuacuuugcccaucacaaucucuuucaugaaggaucuaauagcuuaauccugaucuugcuggaacccauuccgcaguacuccauuccuagcaguuaucacaagcucaaaagucucauggccaggaggacuuauuuggaauggcccaaggaaaagagcaaacguggccuuuuuugggcuaacuuaagggcagccauuaauauuaagcugacagagcaagcaaagaaauag

SEQ ID NO: 9517 - RNA, 2361 nt, Artificial Sequence
  derived and/or modified sequence opt1 from TLR1__Homo_sapiens__AAY85634
augaccagcaucuuccacuucgccaucaucuucaugcugauccuccagauccgcauccagcugagcgaggagagcgaguuccugguggaccgguccaagaacggccucauccacguccccaaggaccugagccagaagaccacgauccugaacaucucccagaacuacaucagcgagcucuggaccuccgacauccugagccuguccaagcuccgcauccugaucaucagccacaaccggauccaguaccuggacaucuccguguucaaguucaaccaggagcucgaguaccuggaccugagccacaacaagcucgugaagaucuccugccacccgaccgucaaccugaagcaccuggaccucagcuucaacgccuucgacgcgcugcccaucugcaaggaguucgggaacaugucccagcugaaguuccucggccugagcaccacgcaccuggagaaguccagcgugcuccccaucgcccaccugaacaucuccaaggugcugcucguccugggggagaccuacggcgagaaggaggaccccgaggggcugcaggacuucaacaccgagagccuccacaucguguucccgaccaacaaggaguuccacuucauccuggacgugagcgucaagacgguggccaaccuggagcucuccaacaucaagugcgugcuggaggacaacaagugcagcuacuuccuguccauccucgccaagcugcagaccaaccccaagcugagcucccucacccugaacaacaucgagaccacguggaacagcuucauccgcauccugcagcucgucuggcacaccaccgugugguacuucuccaucagcaacgugaagcugcagggccagcuggacuuccgggacuucgacuacuccggcaccagccucaaggcccuguccauccaccaggucgugagcgacguguucggguucccccaguccuacaucuacgagaucuucagcaacaugaacaucaagaacuucacggucuccggcacccgcauggugcacaugcugugccccagcaagaucuccccguuccuccaccuggacuucagcaacaaccugcugaccgacaccguguucgagaacugcgggcaccucacggagcuggagacccugauccuccagaugaaccagcugaaggagcuguccaagaucgcggagaugaccacccagaugaagucccuccagcagcuggacaucagccagaacagcgucagcuacgacgagaagaagggcgacugcuccuggaccaagagccugcucucccugaacaugagcuccaacauccugacggacaccaucuuccggugccucccgccccgcaucaaggugcuggaccugcacagcaacaagaucaaguccauccccaagcaggucgugaagcucgaggcccugcaggagcugaacguggccuucaacagccucaccgaccugcccgggugcggcuccuucagcucccugagcguccucaucaucgaccacaacuccgugagccaccccuccgccgacuucuuccagagcugccagaagaugcggagcaucaaggcgggcgacaaccccuuccagugcacgugcgagcugggggaguucgugaagaacaucgaccaggucuccagcgaggugcuggagggcuggcccgacuccuacaagugcgacuacccggagagcuaccgcgggucccuccugaaggacuuccacaugagcgagcuguccugcaacaucacccuccugaucgugaccaucgucgccaccaugcuggugcucgccgugacggucaccagccugugcaucuaccuggaccuccccugguaccugcggauggugugccaguggacccagacccgccggcgcgcccggaacaucccccuggaggagcuccagcgcaaccugcaguuccacgccuucaucuccuacagcggccacgacuccuucugggugaagaacgagcugcuccccaaccuggagaaggagggcaugcagaucugccugcacgagcggaacuucgucccgggcaagagcaucguggagaacaucaucacgugcaucgagaaguccuacaagagcaucuucgugcucucccccaacuucguccagagcgaguggugccacuacgagcuguacuucgcgcaccacaaccuguuccacgagggguccaacagccucauccugauccugcucgagcccaucccccaguacuccaucccgagcagcuaccacaagcugaagucccugauggcccgccggaccuaccucgaguggcccaaggagaaguccaagcgcgggcuguucugggccaaccugcgggccgccaucaacaucaagcucaccgagcaggcgaagaaguga

SEQ ID NO: 9518 - RNA, 2361 nt, Artificial Sequence
  derived and/or modified sequence opt2 from TLR1__Homo_sapiens__AAY85634
augaccuccaucuuccacuucgccaucaucuucaugcucauccuccagauccgcauccagcucuccgaggaguccgaguuccucgucgaccgcuccaagaacggccucauccacguccccaaggaccucucccagaagaccaccauccucaacaucucccagaacuacaucuccgagcucuggaccuccgacauccucucccucuccaagcuccgcauccucaucaucucccacaaccgcauccaguaccucgacaucuccgucuucaaguucaaccaggagcucgaguaccucgaccucucccacaacaagcucgucaagaucuccugccaccccaccgucaaccucaagcaccucgaccucuccuucaacgccuucgacgcccuccccaucugcaaggaguucggcaacaugucccagcucaaguuccucggccucuccaccacccaccucgagaaguccuccguccuccccaucgcccaccucaacaucuccaagguccuccucguccucggcgagaccuacggcgagaaggaggaccccgagggccuccaggacuucaacaccgagucccuccacaucgucuuccccaccaacaaggaguuccacuucauccucgacgucuccgucaagaccgucgccaaccucgagcucuccaacaucaagugcguccucgaggacaacaagugcuccuacuuccucuccauccucgccaagcuccagaccaaccccaagcucuccucccucacccucaacaacaucgagaccaccuggaacuccuucauccgcauccuccagcucgucuggcacaccaccgucugguacuucuccaucuccaacgucaagcuccagggccagcucgacuuccgcgacuucgacuacuccggcaccucccucaaggcccucuccauccaccaggucgucuccgacgucuucggcuucccccaguccuacaucuacgagaucuucuccaacaugaacaucaagaacuucaccgucuccggcacccgcaugguccacaugcucugccccuccaagaucucccccuuccuccaccucgacuucuccaacaaccuccucaccgacaccgucuucgagaacugcggccaccucaccgagcucgagacccucauccuccagaugaaccagcucaaggagcucuccaagaucgccgagaugaccacccagaugaagucccuccagcagcucgacaucucccagaacuccgucuccuacgacgagaagaagggcgacugcuccuggaccaagucccuccucucccucaacauguccuccaacauccucaccgacaccaucuuccgcugccuccccccccgcaucaagguccucgaccuccacuccaacaagaucaaguccauccccaagcaggucgucaagcucgaggcccuccaggagcucaacgucgccuucaacucccucaccgaccuccccggcugcggcuccuucuccucccucuccguccucaucaucgaccacaacuccgucucccaccccuccgccgacuucuuccaguccugccagaagaugcgcuccaucaaggccggcgacaaccccuuccagugcaccugcgagcucggcgaguucgucaagaacaucgaccaggucuccuccgagguccucgagggcuggcccgacuccuacaagugcgacuaccccgaguccuaccgcggcucccuccucaaggacuuccacauguccgagcucuccugcaacaucacccuccucaucgucaccaucgucgccaccaugcucguccucgccgucaccgucaccucccucugcaucuaccucgaccuccccugguaccuccgcauggucugccaguggacccagacccgccgccgcgcccgcaacaucccccucgaggagcuccagcgcaaccuccaguuccacgccuucaucuccuacuccggccacgacuccuucugggucaagaacgagcuccuccccaaccucgagaaggagggcaugcagaucugccuccacgagcgcaacuucguccccggcaaguccaucgucgagaacaucaucaccugcaucgagaaguccuacaaguccaucuucguccucucccccaacuucguccaguccgaguggugccacuacgagcucuacuucgcccaccacaaccucuuccacgagggcuccaacucccucauccucauccuccucgagcccaucccccaguacuccauccccuccuccuaccacaagcucaagucccucauggcccgccgcaccuaccucgaguggcccaaggagaaguccaagcgcggccucuucugggccaaccuccgcgccgccaucaacaucaagcucaccgagcaggccaagaaguga

SEQ ID NO: 9519 - RNA, 2361 nt, Artificial Sequence
  derived and/or modified sequence opt3 from TLR1__Homo_sapiens__AAY85634
augaccagcaucuuccacuuugccauuauauucaugcugauccuccagauuagaauccaacuuuccgaggaaucugaguuucugguggacaggucaaagaacggcuugauucauguccccaaagauuuaagucagaagacaacuauccugaauauaagccagaacuacaucuccgaacuauggacgucugacauucucucgcugucaaaacuucggauccugauuaucagccacaaucgcauacaguauuuggauauuaguguuuucaaguuuaaccaagagcucgaauaccuggaccugucccauaauaaacucgugaagaucucuugccacccuaccguaaacuuaaagcaucuggaucuuagcuucaaugcuuuugacgcauugccaauuuguaaagaguucgggaacaugucccagcugaaguuucuaggacucucaacaacucaccuggagaaaaguagcgugcuuccgaucgcccaccugaauaucucuaaggucuugcucgugcugggugaaaccuauggcgagaaagaagaucccgagggguuacaggacuucaacacagagucccugcauauuguuuuuccuaccaauaaggaguuccacuuuauacucgaugugucagucaagacuguggcgaaccuugaacugagcaauaucaaaugcguauuggaagacaacaaguguaguuacuuccuaucuauucuggcuaaacuccagacaaauccaaagcuguccagccuuacccugaacaacaucgagacgacuuggaacucguucauacgaauuuugcaacucguuuggcauaccacagugugguauuuuucuaucuccaaugucaaacugcagggacaguuagauuuccgugacuuugauuacucaggcacuucacugaaggcccuaagcauccaccaggugguguccgacgucuucgguuuuccccaaucuuauauuuacgaaaucuucagcaauaugaacauuaaaaauuuuaccguuucagggacaagaauggugcacaugcucugcccuaguaagauauccccauuccugcaucuugacuuuagcaacaauuugcugaccgauacgguauucgagaacuguggacaccucacugagcuggaaacacuuauccugcagaugaaucaguugaaggagcucucuaaaauugcagaaaugaccacucaaaugaagucacugcagcaguuagacaucagucagaacagcguguccuacgaugagaaaaagggcgacugcucuuggacaaaaucgcugcuaagccucaauauguccucaaacauccugaccgauacgauuuuuaggugucuucccccucggauaaaggucuuggaccugcauaguaauaagaucaaaucuauuccaaagcaagugguuaaacucgaagcccugcaggaguuaaacguggcuuucaauagccugaccgaucuuccgggcugcggguccuuuaguagcuugucuguccucaucauugaccacaacuccgugagucaucccagcgcagauuucuuccagucuugucagaagaugcgcuccaucaaagccggagacaacccuuuucaaugcacaugugagcugggugaguucguaaagaauauagaucagguuucaagugaagugcuagaaggcuggccagacagcuauaagugcgacuaccccgagucguauagagggucccugcucaaagauuuucacaugucugaacugagcugcaacaucacucuuuugauugucaccaucguggcuacaaugcuggucuuagccgugacuguuaccucacucuguauuuaccuggaccuuccuugguaucugaggauggugugccaguggacacagacccggcgccgagcgagaaauaucccauuggaggagcuccaaaggaaccugcaguuccacgcauuuauaaguuacuccggacaugauucuuucuggguaaagaaugaacuacugcccaaccucgagaaagaaggcaugcagauuugucugcacgagcggaauuuugucccggguaagagcaucguggagaacauuaucacuugcauagaaaaauccuauaagucaaucuucguucuuagcccuaauuuugugcagagugaguggugucauuacgaauuguacuucgcccaccacaaccuguuucaugaggggucuaauuccuuaauucucauccugcuugaacccauuccacaauauagcaucccuucgucauaccacaagcugaaaucucuaauggcucgucgcacguaucucgaguggcccaaggagaaaaguaagagaggacuguucugggccaacuugagggcagcuauaaauauuaaacugacagaacaggccaagaaauga

SEQ ID NO: 9520 - RNA, 2361 nt, Artificial Sequence
  derived and/or modified sequence opt4 from TLR1__Homo_sapiens__AAY85634
augaccagcaucuuccacuucgccaucaucuucaugcugauccugcagaucagaauccagcugagcgaggagagcgaguuccugguggacagaagcaagaacggccugauccacgugcccaaggaccugagccagaagaccaccauccugaacaucagccagaacuacaucagcgagcuguggaccagcgacauccugagccugagcaagcugagaauccugaucaucagccacaacagaauccaguaccuggacaucagcguguucaaguucaaccaggagcuggaguaccuggaccugagccacaacaagcuggugaagaucagcugccaccccaccgugaaccugaagcaccuggaccugagcuucaacgccuucgacgcccugcccaucugcaaggaguucggcaacaugagccagcugaaguuccugggccugagcaccacccaccuggagaagagcagcgugcugcccaucgcccaccugaacaucagcaaggugcugcuggugcugggcgagaccuacggcgagaaggaggaccccgagggccugcaggacuucaacaccgagagccugcacaucguguuccccaccaacaaggaguuccacuucauccuggacgugagcgugaagaccguggccaaccuggagcugagcaacaucaagugcgugcuggaggacaacaagugcagcuacuuccugagcauccuggccaagcugcagaccaaccccaagcugagcagccugacccugaacaacaucgagaccaccuggaacagcuucaucagaauccugcagcugguguggcacaccaccgugugguacuucagcaucagcaacgugaagcugcagggccagcuggacuucagagacuucgacuacagcggcaccagccugaaggcccugagcauccaccagguggugagcgacguguucggcuucccccagagcuacaucuacgagaucuucagcaacaugaacaucaagaacuucaccgugagcggcaccagaauggugcacaugcugugccccagcaagaucagccccuuccugcaccuggacuucagcaacaaccugcugaccgacaccguguucgagaacugcggccaccugaccgagcuggagacccugauccugcagaugaaccagcugaaggagcugagcaagaucgccgagaugaccacccagaugaagagccugcagcagcuggacaucagccagaacagcgugagcuacgacgagaagaagggcgacugcagcuggaccaagagccugcugagccugaacaugagcagcaacauccugaccgacaccaucuucagaugccugccccccagaaucaaggugcuggaccugcacagcaacaagaucaagagcauccccaagcagguggugaagcuggaggcccugcaggagcugaacguggccuucaacagccugaccgaccugcccggcugcggcagcuucagcagccugagcgugcugaucaucgaccacaacagcgugagccaccccagcgccgacuucuuccagagcugccagaagaugagaagcaucaaggccggcgacaaccccuuccagugcaccugcgagcugggcgaguucgugaagaacaucgaccaggugagcagcgaggugcuggagggcuggcccgacagcuacaagugcgacuaccccgagagcuacagaggcagccugcugaaggacuuccacaugagcgagcugagcugcaacaucacccugcugaucgugaccaucguggccaccaugcuggugcuggccgugaccgugaccagccugugcaucuaccuggaccugcccugguaccugagaauggugugccaguggacccagaccagaagaagagccagaaacaucccccuggaggagcugcagagaaaccugcaguuccacgccuucaucagcuacagcggccacgacagcuucugggugaagaacgagcugcugcccaaccuggagaaggagggcaugcagaucugccugcacgagagaaacuucgugcccggcaagagcaucguggagaacaucaucaccugcaucgagaagagcuacaagagcaucuucgugcugagccccaacuucgugcagagcgaguggugccacuacgagcuguacuucgcccaccacaaccuguuccacgagggcagcaacagccugauccugauccugcuggagcccaucccccaguacagcauccccagcagcuaccacaagcugaagagccugauggccagaagaaccuaccuggaguggcccaaggagaagagcaagagaggccuguucugggccaaccugagagccgccaucaacaucaagcugaccgagcaggccaagaaguga

SEQ ID NO: 9521 - RNA, 2361 nt, Artificial Sequence
  derived and/or modified sequence opt5 from TLR1__Homo_sapiens__AAY85634
augaccagcaucuuccacuuugccauuaucuucaugcugauucuccagauccggauucaacuguccgaggaaucugaguuucuuguggacagaagcaagaacggccugauccauguccccaaagaucucucccagaagacaacgauccugaauauuucucagaacuacaucagcgaacuuuggaccuccgacauucugucucucagcaaacugcgcauccugauuaucucccacaauagaauccaguaucucgauauuagcguuuucaaguuuaaccaagagcuggaauaccuugaccugucucauaauaaacucgugaagaucuccugccacccuacagugaaccugaagcaucuugaucugagcuucaaugcuuuugacgcccucccgauuuguaaagaguucgggaacaugucucagcugaaguuucugggacucuccaccacacaccuggagaaaagcucuguccuucccaucgcgcaccugaauauuuccaaggugcuccugguucuuggcgaaaccuauggggagaaagaagauccugagggacugcaggacuucaacacagagagccuccauaucguguuucccaccaauaaggaguuccacuuuauucuggaugucuccgugaagacgguugcuaaccuggaacucucuaauaucaaaugcgugcuggaagacaacaaguguagcuacuuccuuuccauccuggccaaacuccagaccaauccuaagcugagcucucuuacacugaacaacauugagaccacauggaauagcuucauccggauucuccaacuggucuggcauaccacggugugguauuuuagcaucucuaacgugaaacugcagggccagcucgauuuccgcgacuuugauuacagcgggacaucccugaaggcccuuucuauucaccaggucguuagcgacguguucggauuuccccaauccuauaucuacgaaaucuucagcaauaugaacauuaaaaauuuuaccgugucuggcacaagaaugguccacaugcugugcccuuccaagaucagcccguuccuccaucuggacuuuucuaacaaucugcuuaccgauaccguguucgagaacuguggccaccucacagagcuggaaacgcugauucuccagaugaaucagcugaaggagcuuuccaaaaucgcugaaaugaccacacaaaugaagucccugcagcagcucgacauuucccagaacucuguuagcuacgaugagaaaaagggggacugcuccuggaccaaaucucugcugagccuuaauauguccagcaacauccucacagauaccauuuuucggugucugcccccucgcaucaaggugcuggaccuccauucuaauaagaucaaauccauucccaagcaagucgugaaacuggaagcccuucaggagcugaacguugcuuucaauagccucacggaucugccuggaugcggcucuuuuuccagccugucugugcuuaucauugaccacaacagcgucucccaucccagcgccgauuucuuccagucuugucagaagaugagauccaucaaagcgggggacaacccguuucaaugcacaugugagcucggagaguucgugaagaauauugaucaggucagcuccgaagugcuggaaggcuggccugacucuuauaagugcgacuaccccgagagcuaucgggggucccugcucaaagauuuucacaugucugaacugagcugcaacaucacccuucugaucguuaccauuguggccacaaugcucguccuggcugugaccguuacaucccuguguaucuaccuugaccucccuugguaucugcgcauggugugccaguggacgcagaccagacggcgcgccagaaauauuccccuggaggagcuccaacggaaccugcaguuccacgcuuuuaucucuuacagcggacaugauuccuucugggucaagaaugaacuucugcccaaccucgagaaagaaggcaugcagauuugucugcacgagcgcaauuuugugccuggcaagagcaucguggagaacaucauuacaugcaucgaaaaaucuuauaaguccauuuucguucugagcccgaauuuuguccagucugaguggugucauuacgaacuuuacuucgcccaccacaaccuguuucaugagggguccaauagccucauccugauucuccuggaacccaucccucaauauucuauccccuccagcuaccacaaacuuaagucccugauggcgagacggaccuaucucgaguggccuaaggagaaaagcaagagaggacuguucugggccaaccugcgcgcugccauuaauaucaaacuuacagaacaggcuaagaaauga

SEQ ID NO: 9522 - protein, 786 aa, Artificial Sequence [sequence omitted]

SEQ ID NO: 9523 - RNA, 2361 nt, Artificial Sequence
  TLR1__Homo_sapiens__AAY85635
augacuagcaucuuccauuuugccauuaucuucauguuaauacuucagaucagaauacaauuaucugaagaaagugaauuuuuaguugauaggucaaaaaacggucucauccacguuccuaaagaccuaucccagaaaacaacaaucuuaaauauaucgcaaaauuauauaucugagcuuuggacuucugacaucuuaucacugucaaaacugaggauuuugauaauuucucauaauagaauccaguaucuugauaucaguguuuucaaauucaaccaggaauuggaauacuuggauuugucccacaacaaguuggugaagauuucuugccacccuacugugaaccucaagcacuuggaccugucauuuaaugcauuugaugcccugccuauaugcaaagaguuuggcaauaugucucaacuaaaauuucugggguugagcaccacacacuuagaaaaaucuagugugcugccaauugcucauuugaauaucagcaaggucuugcuggucuuaggagagacuuauggggaaaaagaagacccugagggccuucaagacuuuaacacugagagucugcacauuguguuccccacaaacaaagaauuccauuuuauuuuggaugugucagucaagacuguagcaaaucuggaacuaucuaauaucaaaugugugcuagaagauaacaaauguucuuacuuccuaaguauucuggcgaaacuucaaacaaauccaaaguuaucaagucuuaccuuaaacaacauugaaacaacuuggaauucuuucauuaggauccuccagcugguuuggcauacaacuguaugguauuucucaauuucaaacgugaagcuacagggucagcuggacuucagagauuuugauuauucuggcacuuccuugaaggccuugucuauacaccaaguugucagcgauguguucgguuuuccgcaaaguuauaucuaugaaaucuuuucgaauaugaacaucaaaaauuucacagugucugguacacgcaugguccacaugcuuugcccauccaaaauuagcccguuccugcauuuggauuuuuccaauaaucucuuaacagacacgguuuuugaaaauugugggcaccuuacugaguuggagacacuuauuuuacaaaugaaucaauuaaaagaacuuucaaaaauagcugaaaugacuacacagaugaagucucugcaacaauuggauauuagccagaauucuguaagcuaugaugaaaagaaaggagacuguucuuggacuaaaaguuuauuaaguuuaaauaugucuucaaauauacuuacugacacuauuuucagauguuuaccucccaggaucaagguacuugaucuucacagcaauaaaauaaagagcauuccuaaacaagucguaaaacuggaagcuuugcaagaacucaauguugcuuucaauucuuuaacugaccuuccuggauguggcagcuuuagcagccuuucuguauugaucauugaucacaauucaguuucccacccaucagcugauuucuuccagagcugccagaagaugaggucaauaaaagcaggggacaauccauuccaauguaccugugagcuaggagaauuugucaaaaauauagaccaagcaucaagugaaguguuagagggcuggccugauucuuauaagugugacuacccggaaaguuauagaggaacccuacuaaaggacuuucacaugucugaauuauccugcaacauaacucugcugaucgucaccaucguugccaccaugcugguguuggcugugacugugaccucccucugcaucuacuuggaucugcccugguaucucaggauggugugccaguggacccagacccggcgcagggccaggaacauacccuuagaagaacuccaaagaaaucuccaguuucaugcauuuauuucauauagugggcacgauucuuucugggugaagaaugaauuauugccaaaccuagagaaagaagguaugcagauuugccuucaugagagaaacuuuguuccuggcaagagcauuguggaaaauaucaucaccugcauugagaagaguuacaaguccaucuuuguuuugucucccaacuuuguccagagugaauggugccauuaugaacucuacuuugcccaucacaaucucuuucaugaaggaucuaauagcuuaauccugaucuugcuggaacccauuccgcaguacuccauuccuagcaguuaucacaagcucaaaagucucauggccaggaggacuuauuuggaauggcccaaggaaaagagcaaacguggccuuuuuugggcuaacuuaagggcagccauuaauauuaagcugacagagcaagcaaagaaauag

SEQ ID NO: 9524 - RNA, 2361 nt, Artificial Sequence
  derived and/or modified sequence opt1 from TLR1__Homo_sapiens__AAY85635
augaccagcaucuuccacuucgccaucaucuucaugcugauccuccagauccgcauccagcuguccgaggagagcgaguuccugguggaccgguccaagaacggccucauccacguccccaaggaccugagccagaagaccacgauccugaacaucucccagaacuacaucagcgagcucuggaccuccgacauccugagccuguccaagcuccgcauccugaucaucagccacaaccggauccaguaccuggacaucuccguguucaaguucaaccaggagcucgaguaccuggaccugagccacaacaagcucgugaagaucuccugccacccgaccgucaaccugaagcaccuggaccucagcuucaacgccuucgacgcgcugcccaucugcaaggaguucgggaacaugucccagcugaaguuccucggccugagcaccacgcaccuggagaaguccagcgugcuccccaucgcccaccugaacaucuccaaggugcugcucguccugggggagaccuacggcgagaaggaggaccccgaggggcugcaggacuucaacaccgagagccuccacaucguguucccgaccaacaaggaguuccacuucauccuggacgugagcgucaagacgguggccaaccuggagcucuccaacaucaagugcgugcuggaggacaacaagugcagcuacuuccuguccauccucgccaagcugcagaccaaccccaagcugagcucccucacccugaacaacaucgagaccacguggaacagcuucauccgcauccugcagcucgucuggcacaccaccgugugguacuucuccaucagcaacgugaagcugcagggccagcuggacuuccgggacuucgacuacuccggcaccagccucaaggcccuguccauccaccaggucgugagcgacguguucggguucccccaguccuacaucuacgagaucuucagcaacaugaacaucaagaacuucacggucuccggcacccgcauggugcacaugcugugccccagcaagaucuccccguuccuccaccuggacuucagcaacaaccugcugaccgacaccguguucgagaacugcgggcaccucacggagcuggagacccugauccuccagaugaaccagcugaaggagcuguccaagaucgcggagaugaccacccagaugaagucccuccagcagcuggacaucagccagaacagcgucagcuacgacgagaagaagggcgacugcuccuggaccaagagccugcucucccugaacaugagcuccaacauccugaccgacaccaucuuccggugccucccgccccgcaucaaggugcuggaccugcacagcaacaagaucaaguccauccccaagcaggucgugaagcucgaggcccugcaggagcugaacguggccuucaacagccucaccgaccugcccgggugcggcuccuucagcucccugagcguccucaucaucgaccacaacuccgugagccaccccuccgccgacuucuuccagagcugccagaagaugcggagcaucaaggcgggcgacaaccccuuccagugcacgugcgagcugggggaguucgugaagaacaucgaccaggccuccagcgagguccuggagggcuggcccgacuccuacaagugcgacuacccggagagcuaccgcgggacccuccugaaggacuuccacauguccgagcugagcugcaacaucacccuccugaucgugaccaucguggccacgaugcugguccucgccgugaccgugaccucccugugcaucuaccuggaccuccccugguaccugcggauggucugccaguggacccagacgcgccggcgcgcccggaacaucccccuggaggagcuccagcgcaaccugcaguuccacgcguucaucagcuacuccggccacgacagcuucugggugaagaacgagcugcuccccaaccuggagaaggagggcaugcagaucugccugcacgagcggaacuucgugccggggaaguccaucgucgagaacaucaucacgugcaucgagaaguccuacaagagcaucuucgugcucagccccaacuucgugcaguccgaguggugccacuacgagcuguacuucgcccaccacaaccuguuccacgagggcagcaacucccucauccugauccugcucgagcccaucccccaguacagcaucccguccagcuaccacaagcucaagagccugauggcccgccggaccuaccuggaguggcccaaggagaaguccaagcgcgggcuguucugggccaaccugcgggccgcgaucaacaucaagcucaccgagcaggccaagaaguga

SEQ ID NO: 9525 - RNA, 2361 nt, Artificial Sequence
  derived and/or modified sequence opt2 from TLR1__Homo_sapiens__AAY85635
augaccuccaucuuccacuucgccaucaucuucaugcucauccuccagauccgcauccagcucuccgaggaguccgaguuccucgucgaccgcuccaagaacggccucauccacguccccaaggaccucucccagaagaccaccauccucaacaucucccagaacuacaucuccgagcucuggaccuccgacauccucucccucuccaagcuccgcauccucaucaucucccacaaccgcauccaguaccucgacaucuccgucuucaaguucaaccaggagcucgaguaccucgaccucucccacaacaagcucgucaagaucuccugccaccccaccgucaaccucaagcaccucgaccucuccuucaacgccuucgacgcccuccccaucugcaaggaguucggcaacaugucccagcucaaguuccucggccucuccaccacccaccucgagaaguccuccguccuccccaucgcccaccucaacaucuccaagguccuccucguccucggcgagaccuacggcgagaaggaggaccccgagggccuccaggacuucaacaccgagucccuccacaucgucuuccccaccaacaaggaguuccacuucauccucgacgucuccgucaagaccgucgccaaccucgagcucuccaacaucaagugcguccucgaggacaacaagugcuccuacuuccucuccauccucgccaagcuccagaccaaccccaagcucuccucccucacccucaacaacaucgagaccaccuggaacuccuucauccgcauccuccagcucgucuggcacaccaccgucugguacuucuccaucuccaacgucaagcuccagggccagcucgacuuccgcgacuucgacuacuccggcaccucccucaaggcccucuccauccaccaggucgucuccgacgucuucggcuucccccaguccuacaucuacgagaucuucuccaacaugaacaucaagaacuucaccgucuccggcacccgcaugguccacaugcucugccccuccaagaucucccccuuccuccaccucgacuucuccaacaaccuccucaccgacaccgucuucgagaacugcggccaccucaccgagcucgagacccucauccuccagaugaaccagcucaaggagcucuccaagaucgccgagaugaccacccagaugaagucccuccagcagcucgacaucucccagaacuccgucuccuacgacgagaagaagggcgacugcuccuggaccaagucccuccucucccucaacauguccuccaacauccucaccgacaccaucuuccgcugccuccccccccgcaucaagguccucgaccuccacuccaacaagaucaaguccauccccaagcaggucgucaagcucgaggcccuccaggagcucaacgucgccuucaacucccucaccgaccuccccggcugcggcuccuucuccucccucuccguccucaucaucgaccacaacuccgucucccaccccuccgccgacuucuuccaguccugccagaagaugcgcuccaucaaggccggcgacaaccccuuccagugcaccugcgagcucggcgaguucgucaagaacaucgaccaggccuccuccgagguccucgagggcuggcccgacuccuacaagugcgacuaccccgaguccuaccgcggcacccuccucaaggacuuccacauguccgagcucuccugcaacaucacccuccucaucgucaccaucgucgccaccaugcucguccucgccgucaccgucaccucccucugcaucuaccucgaccuccccugguaccuccgcauggucugccaguggacccagacccgccgccgcgcccgcaacaucccccucgaggagcuccagcgcaaccuccaguuccacgccuucaucuccuacuccggccacgacuccuucugggucaagaacgagcuccuccccaaccucgagaaggagggcaugcagaucugccuccacgagcgcaacuucguccccggcaaguccaucgucgagaacaucaucaccugcaucgagaaguccuacaaguccaucuucguccucucccccaacuucguccaguccgaguggugccacuacgagcucuacuucgcccaccacaaccucuuccacgagggcuccaacucccucauccucauccuccucgagcccaucccccaguacuccauccccuccuccuaccacaagcucaagucccucauggcccgccgcaccuaccucgaguggcccaaggagaaguccaagcgcggccucuucugggccaaccuccgcgccgccaucaacaucaagcucaccgagcaggccaagaaguga

SEQ ID NO: 9526 - RNA, 2361 nt, Artificial Sequence
  derived and/or modified sequence opt3 from TLR1__Homo_sapiens__AAY85635
augaccagcaucuuccacuuugccauuauauucaugcugauccuccagauuagaauccaacuuuccgaggaaucugaguuucugguggacaggucaaagaacggcuugauucauguccccaaagauuuaagucagaagacaacuauccugaauauaagccagaacuacaucuccgaacuauggacgucugacauucucucgcugucaaaacuucggauccugauuaucagccacaaucgcauacaguauuuggauauuaguguuuucaaguuuaaccaagagcucgaauaccuggaccugucccauaauaaacucgugaagaucucuugccacccuaccguaaacuuaaagcaucuggaucuuagcuucaaugcuuuugacgcauugccaauuuguaaagaguucgggaacaugucccagcugaaguuucuaggacucucaacaacucaccuggagaaaaguagcgugcuuccgaucgcccaccugaauaucucuaaggucuugcucgugcugggugaaaccuauggcgagaaagaagaucccgagggguuacaggacuucaacacagagucccugcauauuguuuuuccuaccaauaaggaguuccacuuuauacucgaugugucagucaagacuguggcgaaccuugaacugagcaauaucaaaugcguauuggaagacaacaaguguaguuacuuccuaucuauucuggcuaaacuccagacaaauccaaagcuguccagccuuacccugaacaacaucgagacgacuuggaauagcuucauacgaauuuugcaacucguuuggcauaccacagugugguauuuuucuaucuccaacgucaaacugcagggacaguuagauuuccgugacuuugauuacucaggcacuucacugaaggcccuaagcauccaccaggugguguccgacgucuucgguuuuccccaaucuuauauuuacgaaaucuucagcaauaugaacauuaaaaauuuuaccguuucagggacaagaauggugcacaugcucugcccuaguaagauauccccauuccugcaucuugacuuuagcaacaauuugcugaccgauacgguauucgagaacuguggacaccucacugagcuggaaacacuuauccugcagaugaaucaguugaaggagcucucuaaaauugcagaaaugaccacucaaaugaagucacugcagcaguuagacaucagucagaacagcguguccuacgaugagaaaaagggcgacugcucuuggacaaaaucgcugcuaagccucaauauguccucaaacauccugaccgauacgauuuuuaggugucuucccccucggauaaaggucuuggaccugcauaguaauaagaucaaaucuauuccaaagcaagugguuaaacucgaagcccugcaggaguuaaacguggcuuucaauagccugaccgaucuuccgggcugcggguccuuuaguagcuugucuguccucaucauugaccacaacuccgugagucaucccagcgcagauuucuuccagucuugucagaagaugcgcuccaucaaagccggagacaacccuuuucaaugcacaugugagcugggugaguucguaaagaauauagaucaggcuucaagugaaguucuagaaggcuggccagacagcuauaagugcgacuaccccgagucguauagagggacucugcucaaagauuuucacauguccgaacugucuugcaacaucacccuuuugauugugacaaucgucgccacuaugcugguguuagcggucaccgugacaagccucuguauuuaccuggaccuuccuugguaucugaggaugguuugccaguggacccagacucggcgccgagcaagaaauaucccauuggaggagcuccaaaggaaccugcaguuccacgccuuuauaucauacaguggacaugauuccuucugggugaagaaugaacuacugcccaaccucgagaaagaaggcaugcagauuugucugcacgagcggaauuuuguaccggguaagucuaucgucgagaacauuaucacgugcauagaaaaaucguauaaguccaucuucgugcuuucaccuaauuuuguucagagcgaguggugucauuacgaauuguacuucgcucaccacaaccuguuucaugaggggaguaauucuuuaauucucauccugcuugaacccauuccacaauauuccaucccuagcucguaccacaagcugaaaucacuaauggcccgucgcacauaucucgaguggcccaaggagaaaucuaagagaggacuguucugggcaaacuugagggcugccauaaauauuaaacugaccgaacaggcgaagaaauga

SEQ ID NO: 9527 - RNA, 2361 nt, Artificial Sequence
  derived and/or modified sequence opt4 from TLR1__Homo_sapiens__AAY85635
augaccagcaucuuccacuucgccaucaucuucaugcugauccugcagaucagaauccagcugagcgaggagagcgaguuccugguggacagaagcaagaacggccugauccacgugcccaaggaccugagccagaagaccaccauccugaacaucagccagaacuacaucagcgagcuguggaccagcgacauccugagccugagcaagcugagaauccugaucaucagccacaacagaauccaguaccuggacaucagcguguucaaguucaaccaggagcuggaguaccuggaccugagccacaacaagcuggugaagaucagcugccaccccaccgugaaccugaagcaccuggaccugagcuucaacgccuucgacgcccugcccaucugcaaggaguucggcaacaugagccagcugaaguuccugggccugagcaccacccaccuggagaagagcagcgugcugcccaucgcccaccugaacaucagcaaggugcugcuggugcugggcgagaccuacggcgagaaggaggaccccgagggccugcaggacuucaacaccgagagccugcacaucguguuccccaccaacaaggaguuccacuucauccuggacgugagcgugaagaccguggccaaccuggagcugagcaacaucaagugcgugcuggaggacaacaagugcagcuacuuccugagcauccuggccaagcugcagaccaaccccaagcugagcagccugacccugaacaacaucgagaccaccuggaacagcuucaucagaauccugcagcugguguggcacaccaccgugugguacuucagcaucagcaacgugaagcugcagggccagcuggacuucagagacuucgacuacagcggcaccagccugaaggcccugagcauccaccagguggugagcgacguguucggcuucccccagagcuacaucuacgagaucuucagcaacaugaacaucaagaacuucaccgugagcggcaccagaauggugcacaugcugugccccagcaagaucagccccuuccugcaccuggacuucagcaacaaccugcugaccgacaccguguucgagaacugcggccaccugaccgagcuggagacccugauccugcagaugaaccagcugaaggagcugagcaagaucgccgagaugaccacccagaugaagagccugcagcagcuggacaucagccagaacagcgugagcuacgacgagaagaagggcgacugcagcuggaccaagagccugcugagccugaacaugagcagcaacauccugaccgacaccaucuucagaugccugccccccagaaucaaggugcuggaccugcacagcaacaagaucaagagcauccccaagcagguggugaagcuggaggcccugcaggagcugaacguggccuucaacagccugaccgaccugcccggcugcggcagcuucagcagccugagcgugcugaucaucgaccacaacagcgugagccaccccagcgccgacuucuuccagagcugccagaagaugagaagcaucaaggccggcgacaaccccuuccagugcaccugcgagcugggcgaguucgugaagaacaucgaccaggccagcagcgaggugcuggagggcuggcccgacagcuacaagugcgacuaccccgagagcuacagaggcacccugcugaaggacuuccacaugagcgagcugagcugcaacaucacccugcugaucgugaccaucguggccaccaugcuggugcuggccgugaccgugaccagccugugcaucuaccuggaccugcccugguaccugagaauggugugccaguggacccagaccagaagaagagccagaaacaucccccuggaggagcugcagagaaaccugcaguuccacgccuucaucagcuacagcggccacgacagcuucugggugaagaacgagcugcugcccaaccuggagaaggagggcaugcagaucugccugcacgagagaaacuucgugcccggcaagagcaucguggagaacaucaucaccugcaucgagaagagcuacaagagcaucuucgugcugagccccaacuucgugcagagcgaguggugccacuacgagcuguacuucgcccaccacaaccuguuccacgagggcagcaacagccugauccugauccugcuggagcccaucccccaguacagcauccccagcagcuaccacaagcugaagagccugauggccagaagaaccuaccuggaguggcccaaggagaagagcaagagaggccuguucugggccaaccugagagccgccaucaacaucaagcugaccgagcaggccaagaaguga

SEQ ID NO: 9528 - RNA, 2361 nt, Artificial Sequence
  derived and/or modified sequence opt5 from TLR1__Homo_sapiens__AAY85635
augaccagcaucuuccacuuugccauuaucuucaugcugauucuccagauccggauucaacuguccgaggaaucugaguuucuuguggacagaagcaagaacggccugauccauguccccaaagaucucucccagaagacaacgauccugaauauuucucagaacuacaucagcgaacuuuggaccuccgacauucugucucucagcaaacugcgcauccugauuaucucccacaauagaauccaguaucucgauauuagcguuuucaaguuuaaccaagagcuggaauaccuugaccugucucauaauaaacucgugaagaucuccugccacccuacagugaaccugaagcaucuugaucugagcuucaaugcuuuugacgcccucccgauuuguaaagaguucgggaacaugucucagcugaaguuucugggacucuccaccacacaccuggagaaaagcucuguccuucccaucgcgcaccugaauauuuccaaggugcuccugguucuuggcgaaaccuauggggagaaagaagauccugagggacugcaggacuucaacacagagagccuccauaucguguuucccaccaauaaggaguuccacuuuauucuggaugucuccgugaagacgguugcuaaccuggaacucucuaauaucaaaugcgugcuggaagacaacaaguguagcuacuuccuuuccauccuggccaaacuccagaccaauccuaagcugagcucucuuacacugaacaacauugagaccacauggaauagcuucauccggauucuccaacuggucuggcauaccacggugugguauuuuagcaucucuaacgugaaacugcagggccagcucgauuuccgcgacuuugauuacagcgggacaucccugaaggcccuuucuauucaccaggucguuagcgacguguucggauuuccccaauccuauaucuacgaaaucuucagcaauaugaacauuaaaaauuuuaccgugucuggcacaagaaugguccacaugcugugcccuuccaagaucagcccguuccuccaucuggacuuuucuaacaaucugcuuaccgauaccguguucgagaacuguggccaccucacagagcuggaaacgcugauucuccagaugaaucagcugaaggagcuuuccaaaaucgcugaaaugaccacacaaaugaagucccugcagcagcucgacauuucccagaacucuguuagcuacgaugagaaaaagggggacugcuccuggaccaaaucucugcugagccuuaauauguccagcaacauccucacagauaccauuuuucggugucugcccccucgcaucaaggugcuggaccuccauucuaauaagaucaaauccauucccaagcaagucgugaaacuggaagcccuucaggagcugaacguugcuuucaauagccucacggaucugccuggaugcggcucuuuuuccagccugucugugcuuaucauugaccacaacagcgucucccaucccagcgccgauuucuuccagucuugucagaagaugagauccaucaaagcgggggacaacccguuucaaugcacaugugagcucggagaguucgugaagaauauugaucaggccagcuccgaaguccuggaaggcuggccugacucuuauaagugcgacuaccccgagagcuaucgggggacccugcucaaagauuuucacauguccgaacugucuugcaacaucacccuucugaucgugacaauuguugcuaccaugcucgugcuggccgucacagugacgagccuguguaucuaccuugaccucccuugguaucugcgcaugguuugccaguggacccagacaagacggcgcgcuagaaauauuccccuggaggagcuccaacggaaccugcaguuccacgccuuuaucuccuacucuggacaugauagcuucugggugaagaaugaacuucugcccaaccucgagaaagaaggcaugcagauuugucugcacgagcgcaauuuugucccuggcaaguccaucguggagaacaucauuaccugcaucgaaaagagcuauaagucuauuuucgugcuguccccgaauuuuguucagagcgaguggugucauuacgaacuuuacuucgcgcaccacaaccuguuucaugaggggucuaauucccucauccugauucuccuggaacccaucccucaauauagcauccccucuuccuaccacaaacuuaaaagccugauggccagacggacauaucucgaguggccuaaggagaaauccaagagaggacuguucugggcuaaccugcgcgccgcuauuaauaucaaacuuaccgaacaggccaagaaauga

SEQ ID NO: 9529 - protein, 786 aa, Artificial Sequence [sequence omitted]

SEQ ID NO: 9530 - RNA, 2361 nt, Artificial Sequence
  TLR1__Homo_sapiens__AAY85637
augacuagcaucuuccauuuugccauuaucuucauguuaauacuucagaucagaauacaauuaucugaagaaagugaauuuuuaguugauaggucaaaaaacggucucauccacguuccuaaagaccuaucccagaaaacaacaaucuuaaauauaucgcaaaauuauauaucugagcuuuggacuucugacaucuuaucacugucaaaacugaggauuuugauaauuucucauaauagaauccaguaucuugauaucaguguuuucaaauucaaccaggaauuggaauacuuggauuugucccacaacaaguuggugaagauuucuugccacccuacugugaaccucaagcacuuggaccugucauuuaaugcauuugaugcccugccuauaugcaaagaguuuggcaauaugucucaacuaaaauuucugggguugagcaccacacacuuagaaaaaucuagugugcugccaauugcucauuugaauaucagcaaggucuugcuggucuuaggagagacuuauggggaaaaagaagacccugagggccuucaagacuuuaacacugagagucugcacauuguguuccccacaaacaaagaauuccauuuuauuuuggaugugucagucaagacuguagcaaaucuggaacuaucuaauaucaaaugugugcuagaagauaacaaauguucuuacuuccuaaguauucuggcgaaacuucaaacaaauccaaaguuaucaagucuuaccuuaaacaacauugaaacaacuuggaauucuuucauuaggauccuccagcugguuuggcauacaacuguaugguauuucucaauuucaaacgugaagcuacagggucagcuggacuucagagauuuugauuauucuggcacuuccuugaaggccuugucuauacaccaaguugucagcgauguguucgguuuuccgcaaaguuauaucuaugaaaucuuuucgaauaugaacaucaaaaauuucacagugucugguacacgcaugguccacaugcuuugcccauccaaaauuagcccguuccugcauuuggauuuuuccaauaaucucuuaacagacacgguuuuugaaaauugugggcaccuuacugaguuggagacacuuauuuuacaaaugaaucaauuaaaagaacuuucaaaaauagcugaaaugacuacacagaugaagucucugcaacaauuggauauuagccagaauucuguaagcuaugaugaaaagaaaggagacuguucuuggacuaaaaguuuauuaaguuuaaauaugucuucaaauauacuuacugacacuauuuucagauguauaccucccaggaucaagguacuugaucuucacagcaauaaaauaaagagcauuccuaaacaagucguaaaacuggaagcuuugcaagaacucaauguugcuuucaauucuuuaacugaccuuccuggauguggcagcuuuagcagccuuucuguauugaucauugaucacaauucaguuucccacccaucagcugauuucuuccagagcugccagaagaugaggucaauaaaagcaggggacaauccauuccaauguaccugugagcuaggagaauuugucaaaaauauagaccaaguaucaagugaaguguuagagggcuggccugauucuuauaagugugacuacccggaaaguuauagaggaacccuacuaaaggacuuucacaugucugaauuauccugcaacauaacucugcugaucgucaccaucguugccaccaugcugguguuggcugugacugugaccucccucugcaucuacuuggaucugcccugguaucucaggauggugugccaguggacccagacccggcgcagggccaggaacauacccuuagaagaacuccaaagaaaucuccaguuucaugcauuuauuucauauagugggcacgauucuuucugggugaagaaugaauuauugccaaaccuagagaaagaagguaugcagauuugccuucaugagagaaacuuuguuccuggcaagagcauuguggaaaauaucaucaccugcauugagaagaguuacaaguccaucuuuguuuugucucccaacuuuguccagagugaauggugccauuaugaacucuacuuugcccaucacaaucucuuucaugaaggaucuaauagcuuaauccugaucuugcuggaacccauuccgcaguacuccauuccuagcaguuaucacaagcucaaaagucucauggccaggaggacuuauuuggaauggcccaaggaaaagagcaaacguggccuuuuuugggcuaacuuaagggcagccauuaauauuaagcugacagagcaagcaaagaaauag

SEQ ID NO: 9531 - RNA, 2361 nt, Artificial Sequence
  derived and/or modified sequence opt1 from TLR1__Homo_sapiens__AAY85637
augaccagcaucuuccacuucgccaucaucuucaugcugauccuccagauccgcauccagcuguccgaggagagcgaguuccugguggaccgguccaagaacgggcucauccacguccccaaggaccugagccagaagaccacgauccugaacaucucccagaacuacaucagcgagcucuggaccuccgacauccugagccuguccaagcuccgcauccugaucaucagccacaaccggauccaguaccuggacaucuccguguucaaguucaaccaggagcucgaguaccuggaccugagccacaacaagcucgugaagaucuccugccacccgaccgucaaccugaagcaccuggaccucagcuucaacgccuucgacgcgcugcccaucugcaaggaguucgggaacaugucccagcugaaguuccucggccugagcaccacgcaccuggagaaguccagcgugcuccccaucgcccaccugaacaucuccaaggugcugcucguccugggggagaccuacggcgagaaggaggaccccgaggggcugcaggacuucaacaccgagagccuccacaucguguucccgaccaacaaggaguuccacuucauccuggacgugagcgucaagacgguggccaaccuggagcucuccaacaucaagugcgugcuggaggacaacaagugcagcuacuuccuguccauccucgccaagcugcagaccaaccccaagcugagcucccucacccugaacaacaucgagaccacguggaacagcuucauccgcauccugcagcucgucuggcacaccaccgugugguacuucuccaucagcaacgugaagcugcagggccagcuggacuuccgggacuucgacuacuccggcaccagccucaaggcccuguccauccaccaggucgugagcgacguguucggguucccccaguccuacaucuacgagaucuucagcaacaugaacaucaagaacuucacggucuccggcacccgcauggugcacaugcugugccccagcaagaucuccccguuccuccaccuggacuucagcaacaaccugcugaccgacaccguguucgagaacugcgggcaccucacggagcuggagacccugauccuccagaugaaccagcugaaggagcuguccaagaucgcggagaugaccacccagaugaagucccuccagcagcuggacaucagccagaacagcgucagcuacgacgagaagaagggcgacugcuccuggaccaagagccugcucucccugaacaugagcuccaacauccugaccgacaccaucuuccggugcaucccgccccgcaucaaggugcucgaccugcacagcaacaagaucaaguccauccccaagcaggucgugaagcuggaggcccuccaggagcugaacguggccuucaacagccugaccgaccuccccgggugcggcuccuucagcucccugagcguccugaucaucgaccacaacuccgugagccaccccuccgccgacuucuuccagagcugccagaagaugcggagcaucaaggcgggcgacaaccccuuccagugcacgugcgagcucggggaguucgugaagaacaucgaccaggucuccagcgaggugcuggagggcuggcccgacuccuacaagugcgacuacccggagagcuaccgcgggacccugcucaaggacuuccacauguccgagcugagcugcaacaucacccugcucaucgugaccaucgucgccacgaugcuggugcuggccgugaccgucaccucccucugcaucuaccuggaccugcccugguaccuccggauggugugccaguggacccagacgcgccggcgcgcccggaacaucccccuggaggagcugcagcgcaaccuccaguuccacgccuucaucagcuacuccggccacgacagcuucugggugaagaacgagcugcugcccaaccucgagaaggagggcaugcagaucugccugcacgagcggaacuucgucccggggaaguccaucguggagaacaucaucacgugcaucgagaaguccuacaagagcaucuucgugcugagccccaacuucguccaguccgaguggugccacuacgagcucuacuucgcgcaccacaaccuguuccacgagggcagcaacucccugauccucauccugcuggagcccaucccccaguacagcaucccguccagcuaccacaagcucaagagccugauggcccgccggaccuaccuggaguggcccaaggagaaguccaagcgcggccucuucugggccaaccugcgggccgccaucaacaucaagcugaccgagcaggcgaagaaguga

SEQ ID NO: 9532 - RNA, 2361 nt, Artificial Sequence
  derived and/or modified sequence opt2 from TLR1__Homo_sapiens__AAY85637
augaccuccaucuuccacuucgccaucaucuucaugcucauccuccagauccgcauccagcucuccgaggaguccgaguuccucgucgaccgcuccaagaacggccucauccacguccccaaggaccucucccagaagaccaccauccucaacaucucccagaacuacaucuccgagcucuggaccuccgacauccucucccucuccaagcuccgcauccucaucaucucccacaaccgcauccaguaccucgacaucuccgucuucaaguucaaccaggagcucgaguaccucgaccucucccacaacaagcucgucaagaucuccugccaccccaccgucaaccucaagcaccucgaccucuccuucaacgccuucgacgcccuccccaucugcaaggaguucggcaacaugucccagcucaaguuccucggccucuccaccacccaccucgagaaguccuccguccuccccaucgcccaccucaacaucuccaagguccuccucguccucggcgagaccuacggcgagaaggaggaccccgagggccuccaggacuucaacaccgagucccuccacaucgucuuccccaccaacaaggaguuccacuucauccucgacgucuccgucaagaccgucgccaaccucgagcucuccaacaucaagugcguccucgaggacaacaagugcuccuacuuccucuccauccucgccaagcuccagaccaaccccaagcucuccucccucacccucaacaacaucgagaccaccuggaacuccuucauccgcauccuccagcucgucuggcacaccaccgucugguacuucuccaucuccaacgucaagcuccagggccagcucgacuuccgcgacuucgacuacuccggcaccucccucaaggcccucuccauccaccaggucgucuccgacgucuucggcuucccccaguccuacaucuacgagaucuucuccaacaugaacaucaagaacuucaccgucuccggcacccgcaugguccacaugcucugccccuccaagaucucccccuuccuccaccucgacuucuccaacaaccuccucaccgacaccgucuucgagaacugcggccaccucaccgagcucgagacccucauccuccagaugaaccagcucaaggagcucuccaagaucgccgagaugaccacccagaugaagucccuccagcagcucgacaucucccagaacuccgucuccuacgacgagaagaagggcgacugcuccuggaccaagucccuccucucccucaacauguccuccaacauccucaccgacaccaucuuccgcugcauccccccccgcaucaagguccucgaccuccacuccaacaagaucaaguccauccccaagcaggucgucaagcucgaggcccuccaggagcucaacgucgccuucaacucccucaccgaccuccccggcugcggcuccuucuccucccucuccguccucaucaucgaccacaacuccgucucccaccccuccgccgacuucuuccaguccugccagaagaugcgcuccaucaaggccggcgacaaccccuuccagugcaccugcgagcucggcgaguucgucaagaacaucgaccaggucuccuccgagguccucgagggcuggcccgacuccuacaagugcgacuaccccgaguccuaccgcggcacccuccucaaggacuuccacauguccgagcucuccugcaacaucacccuccucaucgucaccaucgucgccaccaugcucguccucgccgucaccgucaccucccucugcaucuaccucgaccuccccugguaccuccgcauggucugccaguggacccagacccgccgccgcgcccgcaacaucccccucgaggagcuccagcgcaaccuccaguuccacgccuucaucuccuacuccggccacgacuccuucugggucaagaacgagcuccuccccaaccucgagaaggagggcaugcagaucugccuccacgagcgcaacuucguccccggcaaguccaucgucgagaacaucaucaccugcaucgagaaguccuacaaguccaucuucguccucucccccaacuucguccaguccgaguggugccacuacgagcucuacuucgcccaccacaaccucuuccacgagggcuccaacucccucauccucauccuccucgagcccaucccccaguacuccauccccuccuccuaccacaagcucaagucccucauggcccgccgcaccuaccucgaguggcccaaggagaaguccaagcgcggccucuucugggccaaccuccgcgccgccaucaacaucaagcucaccgagcaggccaagaaguga

SEQ ID NO: 9533 - RNA, 2361 nt, Artificial Sequence
  derived and/or modified sequence opt3 from TLR1__Homo_sapiens__AAY85637
augaccagcaucuuccacuuugccauuauauucaugcugauccuccagauuagaauccaacuuuccgaggaaucugaguuucugguggacaggucaaagaacggcuugauucauguccccaaagauuuaagucagaagacaacuauccugaauauaagccagaacuacaucuccgaacuauggacgucugacauucucucgcugucaaaacuucggauccugauuaucagccacaaucgcauacaguauuuggauauuaguguuuucaaguuuaaccaagagcucgaauaccuggaccugucccauaauaaacucgugaagaucucuugccacccuaccguaaacuuaaagcaucuggaucuuagcuucaaugcuuuugacgcauugccaauuuguaaagaguucgggaacaugucccagcugaaguuucuaggacucucaacaacucaccuggagaaaaguagcgugcuuccgaucgcccaccugaauaucucuaaggucuugcucgugcugggugaaaccuauggcgagaaagaagaucccgagggguuacaggacuucaacacagagucccugcauauuguuuuuccuaccaauaaggaguuccacuuuauacucgaugugucagucaagacuguggcgaaccuugaacugagcaauaucaaaugcguauuggaagacaacaaguguaguuacuuccuaucuauucuggcuaaacuccagacaaauccaaagcuguccagccuuacccugaacaacaucgagacgacuuggaacucguucauacgaauuuugcaacucguuuggcauaccacagugugguauuuuucuaucuccaaugucaaacugcagggacaguuagauuuccgugacuuugauuacucaggcacaagucugaaggcccuaagcauccaccaggugguguccgacgucuucgguuuuccccaaucuuauauuuacgaaaucuucagcaauaugaacauuaaaaauuuuaccguuucagggacaagaauggugcacaugcucugcccuaguaagauauccccauuccugcaucuugacuuuagcaacaauuugcugaccgauacgguauucgagaacuguggacaccucacugagcuggaaacacuuauccugcagaugaaucaguugaaggagcucucuaaaauugcagaaaugaccacucaaaugaagucacugcagcaguuagacaucagucagaacagcguguccuacgaugagaaaaagggcgacugcucuuggacaaaaucgcugcuaagccucaauauguccucaaacauccugaccgauacgauuuuuagguguauacccccucggaucaagguccuugacuugcauaguaauaagauuaaaucuaucccaaagcaagugguuaaacuggaagcccuccaggagcugaacguggcuuucaauagcuuaaccgaucugccgggcugcggguccuuuucaagccuuucugucuugauuaucgaccacaacuccgugagucaucccagcgcagauuucuuccagucuugucagaagaugcgcuccauaaaagccggagacaacccuuuucaaugcacaugugagcucggugaguucguaaagaauaucgaucagguuucaagugaagugcuggaaggcuggccagacagcuauaagugcgacuaccccgagucguauagagggacucuacugaaagauuuucacauguccgaacucucuugcaacauuacccugcuuaucgucacaauuguggcuacuauguugguccuggccgugaccguuacuagcuuauguaucuaccucgaccugccuugguaucuuaggauggugugccaguggacccagacucggcgccgagcgagaaauauaccacuggaggaguugcaaaggaaccuccaguuccacgcauuuauuucauacaguggacaugauuccuucuggguaaagaaugaacugcuacccaaccuggagaaagaaggcaugcagaucugucuccacgagcggaauuuugucccggguaagucuauuguggagaacaucauaacgugcaucgaaaagagcuauaaguccauuuucguucugucaccuaauuuugugcagagcgaguggugucauuacgaacuuuacuucgcccaccacaacuuguuucaugaggggaguaauucucugaucuuaauucuccuggaacccaucccacaauauuccauaccuagcucguaccacaaacuuaaaucacugauggcucgucgcacauaucuagaguggcccaaggagaaaucuaagagaggacucuucugggccaaccugagggcagcuauuaauaucaaauugaccgaacaggccaagaaauga

SEQ ID NO: 9534 - RNA, 2361 nt, Artificial Sequence
  derived and/or modified sequence opt4 from TLR1__Homo_sapiens__AAY85637
augaccagcaucuuccacuucgccaucaucuucaugcugauccugcagaucagaauccagcugagcgaggagagcgaguuccugguggacagaagcaagaacggccugauccacgugcccaaggaccugagccagaagaccaccauccugaacaucagccagaacuacaucagcgagcuguggaccagcgacauccugagccugagcaagcugagaauccugaucaucagccacaacagaauccaguaccuggacaucagcguguucaaguucaaccaggagcuggaguaccuggaccugagccacaacaagcuggugaagaucagcugccaccccaccgugaaccugaagcaccuggaccugagcuucaacgccuucgacgcccugcccaucugcaaggaguucggcaacaugagccagcugaaguuccugggccugagcaccacccaccuggagaagagcagcgugcugcccaucgcccaccugaacaucagcaaggugcugcuggugcugggcgagaccuacggcgagaaggaggaccccgagggccugcaggacuucaacaccgagagccugcacaucguguuccccaccaacaaggaguuccacuucauccuggacgugagcgugaagaccguggccaaccuggagcugagcaacaucaagugcgugcuggaggacaacaagugcagcuacuuccugagcauccuggccaagcugcagaccaaccccaagcugagcagccugacccugaacaacaucgagaccaccuggaacagcuucaucagaauccugcagcugguguggcacaccaccgugugguacuucagcaucagcaacgugaagcugcagggccagcuggacuucagagacuucgacuacagcggcaccagccugaaggcccugagcauccaccagguggugagcgacguguucggcuucccccagagcuacaucuacgagaucuucagcaacaugaacaucaagaacuucaccgugagcggcaccagaauggugcacaugcugugccccagcaagaucagccccuuccugcaccuggacuucagcaacaaccugcugaccgacaccguguucgagaacugcggccaccugaccgagcuggagacccugauccugcagaugaaccagcugaaggagcugagcaagaucgccgagaugaccacccagaugaagagccugcagcagcuggacaucagccagaacagcgugagcuacgacgagaagaagggcgacugcagcuggaccaagagccugcugagccugaacaugagcagcaacauccugaccgacaccaucuucagaugcaucccccccagaaucaaggugcuggaccugcacagcaacaagaucaagagcauccccaagcagguggugaagcuggaggcccugcaggagcugaacguggccuucaacagccugaccgaccugcccggcugcggcagcuucagcagccugagcgugcugaucaucgaccacaacagcgugagccaccccagcgccgacuucuuccagagcugccagaagaugagaagcaucaaggccggcgacaaccccuuccagugcaccugcgagcugggcgaguucgugaagaacaucgaccaggugagcagcgaggugcuggagggcuggcccgacagcuacaagugcgacuaccccgagagcuacagaggcacccugcugaaggacuuccacaugagcgagcugagcugcaacaucacccugcugaucgugaccaucguggccaccaugcuggugcuggccgugaccgugaccagccugugcaucuaccuggaccugcccugguaccugagaauggugugccaguggacccagaccagaagaagagccagaaacaucccccuggaggagcugcagagaaaccugcaguuccacgccuucaucagcuacagcggccacgacagcuucugggugaagaacgagcugcugcccaaccuggagaaggagggcaugcagaucugccugcacgagagaaacuucgugcccggcaagagcaucguggagaacaucaucaccugcaucgagaagagcuacaagagcaucuucgugcugagccccaacuucgugcagagcgaguggugccacuacgagcuguacuucgcccaccacaaccuguuccacgagggcagcaacagccugauccugauccugcuggagcccaucccccaguacagcauccccagcagcuaccacaagcugaagagccugauggccagaagaaccuaccuggaguggcccaaggagaagagcaagagaggccuguucugggccaaccugagagccgccaucaacaucaagcugaccgagcaggccaagaaguga

SEQ ID NO: 9535 - RNA, 2361 nt, Artificial Sequence
  derived and/or modified sequence opt5 from TLR1__Homo_sapiens__AAY85637
augaccagcaucuuccacuuugccauuaucuucaugcugauucuccagaucagaauccaacuguccgaggaaucugaguuucuuguggaccggagcaagaacggccugauccauguccccaaagaucucucccagaagacaacgauccugaauauuucucagaacuacaucagcgaacuuuggaccuccgacauucugucucucagcaaacugcgcauccugauuaucucccacaauagaauccaguaucucgauaucagcguuuucaaguuuaaccaagagcuggaauaccuugaccugucucauaauaaacucgugaagaucuccugccacccuacagugaaccugaagcaucuugaucugagcuucaaugcuuuugacgcccucccgauuuguaaagaguucgggaacaugucucagcugaaguuucugggacucuccaccacacaccuggagaaaagcucuguccuucccaucgcgcaccugaauauuuccaaggugcuccugguucuuggcgaaaccuauggggagaaagaagauccugagggacugcaggacuucaacacagagagccuccauaucguguuucccaccaauaaggaguuccacuuuauucuggaugucuccgugaagacgguugcuaaccuggaacucucuaauaucaaaugcgugcuggaagacaacaaguguagcuacuuccuuuccauccuggccaaacuccagaccaauccuaagcugagcucucuuacacugaacaacauugagaccacauggaacuccuucauccggauucuccaacuggucuggcauaccacggugugguauuuuagcaucucuaaugugaaacugcagggccagcucgauuuccgcgacuuugauuacagcgggacaucccugaaggcccuuucuauucaccaggucguuagcgacguguucggauuuccccaauccuauaucuacgaaaucuucagcaauaugaacauuaaaaauuuuaccgugucuggcacaagaaugguccacaugcugugcccuuccaagaucagcccguuccuccaucuggacuuuucuaacaaucugcuuaccgauaccguguucgagaacuguggccaccucacagagcuggaaacgcugauucuccagaugaaucagcugaaggagcuuuccaaaaucgcugaaaugaccacacaaaugaaaagccugcagcagcucgacauuucccagaacucuguuagcuacgaugagaaaaagggggacugcuccuggaccaaaucucugcugagccuuaauauguccagcaacauccucacagauaccauuuuucgguguauucccccucgcaucaaggugcuggaccugcauucuaauaagauuaaauccauccccaagcaagucgugaaacucgaagcccugcaggagcuuaacguugcuuucaauagccugacggaucucccuggaugcggcucuuuuuccagccugucugugcugauuaucgaccacaacagcgucucccaucccagcgccgauuucuuccagucuugucagaagaugagauccauuaaagcgggggacaacccguuucaaugcacaugugagcuuggagaguucgugaagaauaucgaucaggucagcuccgaagugcucgaaggcuggccugacucuuauaagugcgacuaccccgagagcuaucgggggacccugcugaaagauuuucacauguccgaacucucuugcaacaucacccugcuuauuguuacaaucguggccaccaugcugguccucgcugugacaguuacgagccuguguauuuaccuggaccuuccuugguaucuccgcauggugugccaguggacccagacaagacggcgcgccagaaauaucccccuggaggagcugcaacggaaccuccaguuccacgcuuuuauuuccuacucuggacaugauagcuucugggucaagaaugaacugcuucccaaccuggagaaagaaggcaugcagaucugucuccacgagcgcaauuuugugccuggcaaguccaucguggagaacauuauuaccugcauugaaaagagcuauaagucuaucuucguucuguccccgaauuuuguccagagcgaguggugucauuacgaacuguacuucgcccaccacaaccuuuuucaugaggggucuaauucccugauucucauccugcucgaacccaucccucaauauagcauucccucuuccuaccacaagcugaaaagccuuauggcgagacggacauaucuggaguggccuaaggagaaauccaagagaggacucuucugggccaaccugcgcgcugccaucaauauuaaacugaccgaacaggcuaagaaauga

SEQ ID NO: 9536 - protein, 786 aa, Artificial Sequence [sequence omitted]

SEQ ID NO: 9537 - RNA, 2361 nt, Artificial Sequence
  TLR1__Homo_sapiens__AAY85641
augacuagcaucuuccauuuugccauuaucuucauguuaauacuucagaucagaauacaauuaucugaagaaagugaauuuuuaguugauaggucaaaaaacggucucauccacguuccuaaagaccuaucccagaaaacaacaaucuuaaauauaucgcaaaauuauauaucugagcuuuggacuucugacaucuuaucacugucaaaacugaggauuuugauaauuucucauaauagaauccaguaucuugauaucaguguuuucaaauucaaccaggaauuggaauacuuggauuugucccacaacaaguuggugaagauuucuugccacccuacugugaaccucaaguacuuggaccugucauuuaaugcauuugaugcccugccuauaugcaaagaguuuggcaauaugucucaacuaaaauuucugggguugagcaccacacacuuagaaaaaucuagugugcugccaauugcucauuugaauaucagcaaggucuugcuggucuuaggagagacuuauggggaaaaagaagacccugagggccuucaagacuuuaacacugagagucugcacauuguguuccccacaaacaaagaauuccauuuuauuuuggaugugucagucaagacuguagcaaaucuggaacuaucuaauaucaaaugugugcuagaagauaacaaauguucuuacuuccuaaguauucuggcgaaacuucaaacaaauccaaaguuaucaagucuuaccuuaaacaacauugaaacaacuuggaauucuuucauuaggauccuccagcugguuuggcauacaacuguaugguauuucucaauuucaaacgugaagcuacagggucagcuggacuucagagauuuugauuauucuggcacuuccuugaaggccuugucuauacaccaaguugucagcgauguguucgguuuuccgcaaaguuauaucuaugaaaucuuuucgaauaugaacaucaaaaauuucacagugucugguacacgcaugguccacaugcuuugcccauccaaaauuagcccguuccugcauuuggauuuuuccaauaaucucuuaacagacacgguuuuugaaaauugugggcaccuuacugaguuggagacacuuauuuuacaaaugaaucaauuaaaagaacuuucaaaaauagcugaaaugacuacacagaugaagucucugcaacaauuggauauuagccagaauucuguaagcuaugaugaaaagaaaggagacuguucuuggacuaaaaguuuauuaaguuuaaauaugucuucaaauauacuuacugacacuauuuucagauguuuaccucccaggaucaagguacuugaucuucacagcaauaaaauaaagagcauuccuaaacaagucguaaaacuggaagcuuugcaagaacucaauguugcuuucaauucuuuaacugaccuuccuggauguggcagcuuuagcagccuuucuguauugaucauugaucacaauucaguuucccacccaucagcugauuucuuccagagcugccagaagaugaggucaauaaaagcaggggacaauccauuccaauguaccugugagcuaggagaauuugucaaaaauauagaccaaguaucaagugaaguguuagagggcuggccugauucuuauaagugugacuacccggaaaguuauagaggaacccuacuaaaggacuuucacaugucugaauuauccugcaacauaacucugcugaucgucaccaucguugccaccaugcugguguuggcugugacugugaccucccucugcaucuacuuggaucugcccugguaucucaggauggugugccaguggacccagacccggcgcagggccaggaacauacccuuagaagaacuccaaagaaaucuccaguuucaugcauuuauuucauauagugggcacgauucuuucugggugaagaaugaauuauugccaaaccuagagaaagaagguaugcagauuugccuucaugagagaaacuuuguuccuggcaagagcauuguggaaaauaucaucaccugcauugagaagaguuacaaguccaucuuuguuuugucucccaacuuuguccagagugaauggugccauuaugaacucuacuuugcccaucacaaucucuuucaugaaggaucuaauagcuuaauccugaucuugcuggaacccauuccgcaguacuccauuccuagcaguuaucacaagcucaaaagucucauggccaggaggacuuauuuggaauggcccaaggaaaagagcaaacguggccuuuuuugggcuaacuuaagggcagccauuaauauuaagcugacagagcaagcaaagaaauag

SEQ ID NO: 9538 - RNA, 2361 nt, Artificial Sequence
  derived and/or modified sequence opt1 from TLR1__Homo_sapiens__AAY85641
augaccagcaucuuccacuucgccaucaucuucaugcugauccuccagauccgcauccagcuguccgaggagagcgaguuccugguggaccgguccaagaacggccucauccacguccccaaggaccugagccagaagaccacgauccugaacaucucccagaacuacaucagcgagcucuggaccuccgacauccugagccuguccaagcuccgcauccugaucaucagccacaaccggauccaguaccuggacaucuccguguucaaguucaaccaggagcucgaguaccuggaccugagccacaacaagcucgugaagaucuccugccacccgaccgucaaccugaaguaccuggaccucagcuucaacgccuucgacgcgcugcccaucugcaaggaguucgggaacaugucccagcugaaguuccucggccugagcaccacgcaccuggagaaguccagcgugcuccccaucgcccaccugaacaucuccaaggugcugcucguccugggggagaccuacggcgagaaggaggaccccgaggggcugcaggacuucaacaccgagagccuccacaucguguucccgaccaacaaggaguuccacuucauccuggacgugagcgucaagacgguggccaaccuggagcucuccaacaucaagugcgugcuggaggacaacaagugcagcuacuuccuguccauccucgccaagcugcagaccaaccccaagcugagcucccucacccugaacaacaucgagaccacguggaacagcuucauccgcauccugcagcucgucuggcacaccaccgugugguacuucuccaucagcaacgugaagcugcagggccagcuggacuuccgggacuucgacuacuccggcaccagccucaaggcccuguccauccaccaggucgugagcgacguguucggguucccccaguccuacaucuacgagaucuucagcaacaugaacaucaagaacuucacggucuccggcacccgcauggugcacaugcugugccccagcaagaucuccccguuccuccaccuggacuucagcaacaaccugcugaccgacaccguguucgagaacugcgggcaccucacggagcuggagacccugauccuccagaugaaccagcugaaggagcuguccaagaucgcggagaugaccacccagaugaagucccuccagcagcuggacaucagccagaacagcgucagcuacgacgagaagaagggcgacugcuccuggaccaagagccugcucucccugaacaugagcuccaacauccugaccgacaccaucuuccggugccucccgccccgcaucaaggugcuggaccugcacagcaacaagaucaaguccauccccaagcaggucgugaagcucgaggcccugcaggagcugaacguggccuucaacagccucaccgaccugcccgggugcggcuccuucagcucccugagcguccucaucaucgaccacaacuccgugagccaccccuccgccgacuucuuccagagcugccagaagaugcggagcaucaaggcgggcgacaaccccuuccagugcacgugcgagcugggggaguucgugaagaacaucgaccaggucuccagcgaggugcuggagggcuggcccgacuccuacaagugcgacuacccggagagcuaccgcgggacccuccugaaggacuuccacauguccgagcugagcugcaacaucacccuccugaucgugaccaucgucgccacgaugcuggugcucgccgugaccgucaccucccugugcaucuaccuggaccuccccugguaccugcggauggugugccaguggacccagacgcgccggcgcgcccggaacaucccccuggaggagcuccagcgcaaccugcaguuccacgccuucaucagcuacuccggccacgacagcuucugggugaagaacgagcugcuccccaaccuggagaaggagggcaugcagaucugccugcacgagcggaacuucgucccggggaaguccaucguggagaacaucaucacgugcaucgagaaguccuacaagagcaucuucgugcucagccccaacuucguccaguccgaguggugccacuacgagcuguacuucgcgcaccacaaccuguuccacgagggcagcaacucccucauccugauccugcucgagcccaucccccaguacagcaucccguccagcuaccacaagcucaagagccugauggcccgccggaccuaccuggaguggcccaaggagaaguccaagcgcgggcuguucugggccaaccugcgggccgccaucaacaucaagcucaccgagcaggcgaagaaguga

SEQ ID NO: 9539 - RNA, 2361 nt, Artificial Sequence
  derived and/or modified sequence opt2 from TLR1__Homo_sapiens__AAY85641
augaccuccaucuuccacuucgccaucaucuucaugcucauccuccagauccgcauccagcucuccgaggaguccgaguuccucgucgaccgcuccaagaacggccucauccacguccccaaggaccucucccagaagaccaccauccucaacaucucccagaacuacaucuccgagcucuggaccuccgacauccucucccucuccaagcuccgcauccucaucaucucccacaaccgcauccaguaccucgacaucuccgucuucaaguucaaccaggagcucgaguaccucgaccucucccacaacaagcucgucaagaucuccugccaccccaccgucaaccucaaguaccucgaccucuccuucaacgccuucgacgcccuccccaucugcaaggaguucggcaacaugucccagcucaaguuccucggccucuccaccacccaccucgagaaguccuccguccuccccaucgcccaccucaacaucuccaagguccuccucguccucggcgagaccuacggcgagaaggaggaccccgagggccuccaggacuucaacaccgagucccuccacaucgucuuccccaccaacaaggaguuccacuucauccucgacgucuccgucaagaccgucgccaaccucgagcucuccaacaucaagugcguccucgaggacaacaagugcuccuacuuccucuccauccucgccaagcuccagaccaaccccaagcucuccucccucacccucaacaacaucgagaccaccuggaacuccuucauccgcauccuccagcucgucuggcacaccaccgucugguacuucuccaucuccaacgucaagcuccagggccagcucgacuuccgcgacuucgacuacuccggcaccucccucaaggcccucuccauccaccaggucgucuccgacgucuucggcuucccccaguccuacaucuacgagaucuucuccaacaugaacaucaagaacuucaccgucuccggcacccgcaugguccacaugcucugccccuccaagaucucccccuuccuccaccucgacuucuccaacaaccuccucaccgacaccgucuucgagaacugcggccaccucaccgagcucgagacccucauccuccagaugaaccagcucaaggagcucuccaagaucgccgagaugaccacccagaugaagucccuccagcagcucgacaucucccagaacuccgucuccuacgacgagaagaagggcgacugcuccuggaccaagucccuccucucccucaacauguccuccaacauccucaccgacaccaucuuccgcugccuccccccccgcaucaagguccucgaccuccacuccaacaagaucaaguccauccccaagcaggucgucaagcucgaggcccuccaggagcucaacgucgccuucaacucccucaccgaccuccccggcugcggcuccuucuccucccucuccguccucaucaucgaccacaacuccgucucccaccccuccgccgacuucuuccaguccugccagaagaugcgcuccaucaaggccggcgacaaccccuuccagugcaccugcgagcucggcgaguucgucaagaacaucgaccaggucuccuccgagguccucgagggcuggcccgacuccuacaagugcgacuaccccgaguccuaccgcggcacccuccucaaggacuuccacauguccgagcucuccugcaacaucacccuccucaucgucaccaucgucgccaccaugcucguccucgccgucaccgucaccucccucugcaucuaccucgaccuccccugguaccuccgcauggucugccaguggacccagacccgccgccgcgcccgcaacaucccccucgaggagcuccagcgcaaccuccaguuccacgccuucaucuccuacuccggccacgacuccuucugggucaagaacgagcuccuccccaaccucgagaaggagggcaugcagaucugccuccacgagcgcaacuucguccccggcaaguccaucgucgagaacaucaucaccugcaucgagaaguccuacaaguccaucuucguccucucccccaacuucguccaguccgaguggugccacuacgagcucuacuucgcccaccacaaccucuuccacgagggcuccaacucccucauccucauccuccucgagcccaucccccaguacuccauccccuccuccuaccacaagcucaagucccucauggcccgccgcaccuaccucgaguggcccaaggagaaguccaagcgcggccucuucugggccaaccuccgcgccgccaucaacaucaagcucaccgagcaggccaagaaguga

SEQ ID NO: 9540 - RNA, 2361 nt, Artificial Sequence
  derived and/or modified sequence opt3 from TLR1__Homo_sapiens__AAY85641
augaccagcaucuuccacuuugccauuauauucaugcugauccuccagauuagaauccaacuuuccgaggaaucugaguuucugguggacaggucaaagaacggcuugauucauguccccaaagauuuaagucagaagacaacuauccugaauauaagccagaacuacaucuccgaacuauggacgucugacauucucucgcugucaaaacuucggauccugauuaucagccacaaucgcauacaguauuuggauauuaguguuuucaaguuuaaccaagagcucgaauaccuggaccugucccauaauaaacucgugaagaucucuugccacccuaccguaaacuuaaaguaucuggaucuuagcuucaaugcuuuugacgcauugccaauuuguaaagaguucgggaacaugucccagcugaaguuucuaggacucucaacaacucaucuggagaaaaguagcgugcuuccgaucgcccaccugaauaucucuaaggucuugcucgugcugggugaaaccuacggcgagaaagaagaucccgagggguuacaggacuucaacacagagucccugcacauuguuuuuccuaccaauaaggaguuccauuuuauacucgaugugucagucaagacuguggcgaaccuugaacugagcaauaucaaaugcguauuggaagacaacaaguguaguuauuuccuaucuauucuggcuaaacuccagacaaauccaaagcuguccagccuuacccugaacaacaucgagacgacuuggaauagcuucauacgaauuuugcaacucguuuggcacaccacagugugguacuuuucuaucuccaacgucaaacugcagggacaguuagauuuccgugacuuugauuauucaggcacuucacugaaggcccuaagcauccaucaggugguguccgacgucuucgguuuuccccaaucuuacauuuacgaaaucuucagcaauaugaacauuaaaaauuuuaccguuucagggacaagaauggugcacaugcucugcccuaguaagauauccccauuccugcaccuugacuuuagcaacaauuugcugaccgauacgguauucgagaacuguggacaucucacugagcuggaaacacuuauccugcagaugaaucaguugaaggagcucucuaaaauugcagaaaugaccacucaaaugaagucacugcagcaguuagacaucagucagaacagcguguccuaugaugagaaaaagggcgacugcucuuggacaaaaucgcugcuaagccucaauauguccucaaacauccugaccgauacgauuuuuaggugucuucccccucggauaaaggucuuggaccugcacaguaauaagaucaaaucuauuccaaagcaagugguuaaacucgaagcccugcaggaguuaaacguggcuuucaauagccugaccgaucuuccgggcugcggguccuuuaguagcuugucuguccucaucauugaccauaacuccgugagucaccccagcgcagauuucuuccagucuugucagaagaugcgcuccaucaaagccggagacaacccuuuucaaugcacaugugagcugggugaguucguaaagaauauagaucagguuucaagugaagugcuagaaggcuggccagacagcuacaagugcgacuaucccgagucguacagagggacucugcucaaagauuuucauauguccgaacugucuugcaacaucacccuuuugauugucacaaucguggcuacuaugcuggucuuagccgugaccguuacaagccucuguauuuaucuggaccuuccuugguaccugaggauggugugccaguggacccagacucggcgccgagcgagaaauaucccauuggaggagcuccaaaggaaccugcaguuccacgcauuuauaucauauaguggacacgauuccuucuggguaaagaaugaacuacugcccaaccucgagaaagaaggcaugcagauuugucugcaugagcggaauuuugucccggguaagucuaucguggagaacauuaucacgugcauagaaaaaucguacaaguccaucuucguucuuucaccuaauuuugugcagagcgaguggugucacuacgaauuguauuucgcccaucacaaccuguuucacgaggggaguaauucuuuaauucucauccugcuugaacccauuccacaauacuccaucccuagcucguaucauaagcugaaaucacuaauggcucgucgcacauaccucgaguggcccaaggagaaaucuaagagaggacuguucugggccaacuugagggcagcuauaaauauuaaacugaccgaacaggccaagaaauga

SEQ ID NO: 9541 - RNA, 2361 nt, Artificial Sequence
  derived and/or modified sequence opt4 from TLR1__Homo_sapiens__AAY85641
augaccagcaucuuccacuucgccaucaucuucaugcugauccugcagaucagaauccagcugagcgaggagagcgaguuccugguggacagaagcaagaacggccugauccacgugcccaaggaccugagccagaagaccaccauccugaacaucagccagaacuacaucagcgagcuguggaccagcgacauccugagccugagcaagcugagaauccugaucaucagccacaacagaauccaguaccuggacaucagcguguucaaguucaaccaggagcuggaguaccuggaccugagccacaacaagcuggugaagaucagcugccaccccaccgugaaccugaaguaccuggaccugagcuucaacgccuucgacgcccugcccaucugcaaggaguucggcaacaugagccagcugaaguuccugggccugagcaccacccaccuggagaagagcagcgugcugcccaucgcccaccugaacaucagcaaggugcugcuggugcugggcgagaccuacggcgagaaggaggaccccgagggccugcaggacuucaacaccgagagccugcacaucguguuccccaccaacaaggaguuccacuucauccuggacgugagcgugaagaccguggccaaccuggagcugagcaacaucaagugcgugcuggaggacaacaagugcagcuacuuccugagcauccuggccaagcugcagaccaaccccaagcugagcagccugacccugaacaacaucgagaccaccuggaacagcuucaucagaauccugcagcugguguggcacaccaccgugugguacuucagcaucagcaacgugaagcugcagggccagcuggacuucagagacuucgacuacagcggcaccagccugaaggcccugagcauccaccagguggugagcgacguguucggcuucccccagagcuacaucuacgagaucuucagcaacaugaacaucaagaacuucaccgugagcggcaccagaauggugcacaugcugugccccagcaagaucagccccuuccugcaccuggacuucagcaacaaccugcugaccgacaccguguucgagaacugcggccaccugaccgagcuggagacccugauccugcagaugaaccagcugaaggagcugagcaagaucgccgagaugaccacccagaugaagagccugcagcagcuggacaucagccagaacagcgugagcuacgacgagaagaagggcgacugcagcuggaccaagagccugcugagccugaacaugagcagcaacauccugaccgacaccaucuucagaugccugccccccagaaucaaggugcuggaccugcacagcaacaagaucaagagcauccccaagcagguggugaagcuggaggcccugcaggagcugaacguggccuucaacagccugaccgaccugcccggcugcggcagcuucagcagccugagcgugcugaucaucgaccacaacagcgugagccaccccagcgccgacuucuuccagagcugccagaagaugagaagcaucaaggccggcgacaaccccuuccagugcaccugcgagcugggcgaguucgugaagaacaucgaccaggugagcagcgaggugcuggagggcuggcccgacagcuacaagugcgacuaccccgagagcuacagaggcacccugcugaaggacuuccacaugagcgagcugagcugcaacaucacccugcugaucgugaccaucguggccaccaugcuggugcuggccgugaccgugaccagccugugcaucuaccuggaccugcccugguaccugagaauggugugccaguggacccagaccagaagaagagccagaaacaucccccuggaggagcugcagagaaaccugcaguuccacgccuucaucagcuacagcggccacgacagcuucugggugaagaacgagcugcugcccaaccuggagaaggagggcaugcagaucugccugcacgagagaaacuucgugcccggcaagagcaucguggagaacaucaucaccugcaucgagaagagcuacaagagcaucuucgugcugagccccaacuucgugcagagcgaguggugccacuacgagcuguacuucgcccaccacaaccuguuccacgagggcagcaacagccugauccugauccugcuggagcccaucccccaguacagcauccccagcagcuaccacaagcugaagagccugauggccagaagaaccuaccuggaguggcccaaggagaagagcaagagaggccuguucugggccaaccugagagccgccaucaacaucaagcugaccgagcaggccaagaaguga

SEQ ID NO: 9542 - RNA, 2361 nt, Artificial Sequence
  derived and/or modified sequence opt5 from TLR1__Homo_sapiens__AAY85641
augaccagcaucuuccacuuugccauuaucuucaugcugauucuccagauccggauucaacuguccgaggaaucugaguuucuuguggacagaagcaagaacggccugauccauguccccaaagaucucucccagaagacaacgauccugaauauuucucagaacuacaucagcgaacuuuggaccuccgacauucugucucucagcaaacugcgcauccugauuaucucccacaauagaauccaguaucucgauauuagcguuuucaaguuuaaccaagagcuggaauaccuugaccugucucauaauaaacucgugaagaucuccugccacccuacagugaaccugaaguaucuugaucugagcuucaaugcuuuugacgcccucccgauuuguaaagaguucgggaacaugucucagcugaaguuucugggacucuccaccacacaucuggagaaaagcucuguccuucccaucgcgcaccugaauauuuccaaggugcuccugguucuuggcgaaaccuacggggagaaagaagauccugagggacugcaggacuucaacacagagagccuccacaucguguuucccaccaauaaggaguuccauuuuauucuggaugucuccgugaagacgguugcuaaccuggaacucucuaauaucaaaugcgugcuggaagacaacaaguguagcuauuuccuuuccauccuggccaaacuccagaccaauccuaagcugagcucucuuacacugaacaacauugagaccacauggaauagcuucauccggauucuccaacuggucuggcacaccacggugugguacuuuagcaucucuaacgugaaacugcagggccagcucgauuuccgcgacuuugauuauagcgggacaucccugaaggcccuuucuauucaucaggucguuagcgacguguucggauuuccccaauccuacaucuacgaaaucuucagcaauaugaacauuaaaaauuuuaccgugucuggcacaagaaugguccacaugcugugcccuuccaagaucagcccguuccuccaccuggacuuuucuaacaaucugcuuaccgauaccguguucgagaacuguggccaucucacagagcuggaaacgcugauucuccagaugaaucagcugaaggagcuuuccaaaaucgcugaaaugaccacacaaaugaagucccugcagcagcucgacauuucccagaacucuguuagcuaugaugagaaaaagggggacugcuccuggaccaaaucucugcugagccuuaauauguccagcaacauccucacagauaccauuuuucggugucugcccccucgcaucaaggugcuggaccuccacucuaauaagaucaaauccauucccaagcaagucgugaaacuggaagcccuucaggagcugaacguugcuuucaauagccucacggaucugccuggaugcggcucuuuuuccagccugucugugcuuaucauugaccauaacagcgucucccaccccagcgccgauuucuuccagucuugucagaagaugagauccaucaaagcgggggacaacccguuucaaugcacaugugagcucggagaguucgugaagaauauugaucaggucagcuccgaagugcuggaaggcuggccugacucuuacaagugcgacuaucccgagagcuaccgggggacccugcucaaagauuuucauauguccgaacugucuugcaacaucacccuucugaucguuacaauuguggccaccaugcucguccuggcugugacaguuacgagccuguguaucuaucuugaccucccuugguaccugcgcauggugugccaguggacccagacaagacggcgcgccagaaauauuccccuggaggagcuccaacggaaccugcaguuccacgcuuuuaucuccuauucuggacacgauagcuucugggucaagaaugaacuucugcccaaccucgagaaagaaggcaugcagauuugucugcaugagcgcaauuuugugccuggcaaguccaucguggagaacaucauuaccugcaucgaaaagagcuacaagucuauuuucguucuguccccgaauuuuguccagagcgaguggugucacuacgaacuuuauuucgcccaucacaaccuguuucacgaggggucuaauucccucauccugauucuccuggaacccaucccucaauacagcauccccucuuccuaucauaaacuuaaaagccugauggcgagacggacauaccucgaguggccuaaggagaaauccaagagaggacuguucugggccaaccugcgcgcugccauuaauaucaaacuuaccgaacaggcuaagaaauga

SEQ ID NO: 9543 - protein, 786 aa, Artificial Sequence [sequence omitted]

SEQ ID NO: 9544 - RNA, 2361 nt, Artificial Sequence
  TLR1__Homo_sapiens__AAY85642
augacuagcaucuuccauuuugccauuaucuucauguuaauacuucagaucagaauacaauuaucugaagaaagugaauuuuuaguugauaggucaaaaaacggucucauccauguuccuaaagaccuaucccagaaaacaacaaucuuaaauauaucgcaaaauuauauaucugagcuuuggacuucugacaucuuaucacugucaaaacugaggauuuugauaauuucucauaauagaauccaguaucuugauaucaguguuuucaaauucaaccaggaauuggaauacuuggauuugucccacaacaaguuggugaagauuucuugccacccuacugugaaccucaagcacuuggaccugucauuuaaugcauuugaugcccugccuauaugcaaagaguuuggcaauaugucucaacuaaaauuucugggguugagcaccacacacuuagaaaaaucuagugugcugccaauugcucauuugaauaucagcaaggucuugcuggucuuaggagagacuuauggggaaaaagaagacccugagggccuucaagacuuuaacacugagagucugcacauuguguuccccacaaacaaagaauuccauuuuauuuuggaugugucagucaagacuguagcaaaucuggaacuaucuaauaucaaaugugugcuagaagauaacaaauguucuuacuuccuaaguauucuggcgaaacuucaaacaaauccaaaguuaucaagucuuaccuuaaacaacauugaaacaacuuggaauucuuucauuaggauccuccagcugguuuggcauacaacuguaugguauuucucaauuucaaacgugaagcuacagggucagcuggacuucagagauuuugauuauucuggcacuuccuugaaggccuugucuauacuccaaguugucagcgauguguucgguuuuccgcaaaguuauaucuaugaaaucuuuucgaauaugaacaucaaaaauuucacagugucugguacacgcaugguccacaugcuuugcccauccaaaauuagcccguuccugcauuuggauuuuuccaauaaucucuuaacagacacgguuuuugaaaauugugggcaccuuacugaguuggagacacuuauuuuacaaaugaaucaauuaaaagaacuuucaaaaauagcugaaaugacuacacagaugaagucucugcaacaauuggauauuagccagaauucuguaagcuaugaugaaaagaaaggagacuguucuuggacuaaaaguuuauuaaguuuaaauaugucuucaaauauacuuacugacacuauuuucagauguuuaccucccaggaucaagguacuugaucuucacagcaauaaaauaaagagcauuccuaaacaagucguaaaacuggaagcuuugcaagaacucaauguugcuuucaauucuuuaacugaccuuccuggauguggcagcuuuagcagccuuucuguauugaucauugaucacaauucaguuucccacccaucagcugauuucuuccagagcugccagaagaugaggucaauaaaagcaggggacaauccauuccaauguaccugugagcuaggagaauuugucaaaaauauagaccaaguaucaagugaaguguuagagggcuggccugauucuuauaagugugacuacccggaaaguuauagaggaacccuacuaaaggacuuucacaugucugaauuauccugcaacauaacucugcugaucgucaccaucguugccaccaugcugguguuggcugugacugugaccucccucugcaucuacuuggaucugcccugguaucucaggauggugugccaguggacccagacccggcgcagggccaggaacauacccuuagaagaacuccaaagaaaucuccaguuucaugcauuuauuucauauagugggcacgauucuuucugggugaagaaugaauuauugccaaaccuagagaaagaagguaugcagauuugccuucaugagagaaacuuuguuccuggcaagagcauuguggaaaauaucaucaccugcauugagaagaguuacaaguccaucuuuguuuugucucccaacuuuguccagagugaauggugccauuaugaacucuacuuugcccaucacaaucucuuucaugaaggaucuaauagcuuaauccugaucuugcuggaacccauuccgcaguacuccauuccuagcaguuaucacaagcucaaaagucucauggccaggaggacuuauuuggaauggcccaaggaaaagagcaaacguggccuuuuuugggcuaacuuaagggcagccauuaauauuaagcugacagagcaagcaaagaaauag

SEQ ID NO: 9545 - RNA, 2361 nt, Artificial Sequence
  derived and/or modified sequence opt1 from TLR1__Homo_sapiens__AAY85642
augaccagcaucuuccacuucgccaucaucuucaugcugauccuccagauccgcauccagcuguccgaggagagcgaguuccugguggaccgguccaagaacggccucauccacguccccaaggaccugagccagaagaccacgauccugaacaucucccagaacuacaucagcgagcucuggaccuccgacauccugagccuguccaagcuccgcauccugaucaucagccacaaccggauccaguaccuggacaucuccguguucaaguucaaccaggagcucgaguaccuggaccugagccacaacaagcucgugaagaucuccugccacccgaccgucaaccugaagcaccuggaccucagcuucaacgccuucgacgcgcugcccaucugcaaggaguucgggaacaugucccagcugaaguuccucggccugagcaccacgcaccuggagaaguccagcgugcuccccaucgcccaccugaacaucuccaaggugcugcucguccugggggagaccuacggcgagaaggaggaccccgaggggcugcaggacuucaacaccgagagccuccacaucguguucccgaccaacaaggaguuccacuucauccuggacgugagcgucaagacgguggccaaccuggagcucuccaacaucaagugcgugcuggaggacaacaagugcagcuacuuccuguccauccucgccaagcugcagaccaaccccaagcugagcucccucacccugaacaacaucgagaccacguggaacagcuucauccgcauccugcagcucgucuggcacaccaccgugugguacuucuccaucagcaacgugaagcugcagggccagcuggacuuccgggacuucgacuacuccggcaccagccucaaggcccuguccauccugcaggucgugagcgacguguucggguucccccaguccuacaucuacgagaucuucagcaacaugaacaucaagaacuucacggucuccggcacccgcauggugcacaugcucugccccagcaagaucuccccguuccugcaccuggacuucagcaacaaccugcucaccgacaccguguucgagaacugcgggcaccugacggagcuggagacccucauccugcagaugaaccagcugaaggagcucuccaagaucgcggagaugaccacccagaugaagucccugcagcagcuggacaucagccagaacagcgucagcuacgacgagaagaagggcgacugcuccuggaccaagagccuccugucccugaacaugagcuccaacauccucaccgacaccaucuuccggugccugccgccccgcaucaaggugcuggaccuccacagcaacaagaucaaguccauccccaagcaggucgugaagcuggaggcccugcaggagcucaacguggccuucaacagccugaccgaccugcccgggugcggcuccuucagcucccucagcguccugaucaucgaccacaacuccgugagccaccccuccgccgacuucuuccagagcugccagaagaugcggagcaucaaggcgggcgacaaccccuuccagugcacgugcgagcugggggaguucgugaagaacaucgaccaggucuccagcgaggugcucgagggcuggcccgacuccuacaagugcgacuacccggagagcuaccgcgggacccugcugaaggacuuccacauguccgagcucagcugcaacaucacccugcugaucgugaccaucgucgccacgaugcucgugcuggccgugaccgucaccucccugugcaucuaccucgaccugcccugguaccugcggauggugugccaguggacccagacgcgccggcgcgcccggaacaucccccucgaggagcugcagcgcaaccugcaguuccacgccuucaucagcuacuccggccacgacagcuucugggugaagaacgagcuccugcccaaccuggagaaggagggcaugcagaucugccuccacgagcggaacuucgucccggggaaguccaucguggagaacaucaucacgugcaucgagaaguccuacaagagcaucuucgugcugagccccaacuucguccaguccgaguggugccacuacgagcuguacuucgcgcaccacaaccucuuccacgagggcagcaacucccugauccugauccuccuggagcccaucccccaguacagcaucccguccagcuaccacaagcucaagagccugauggcccgccggaccuaccuggaguggcccaaggagaaguccaagcgcgggcuguucugggccaaccuccgggccgccaucaacaucaagcugaccgagcaggcgaagaaguga

SEQ ID NO: 9546 - RNA, 2361 nt, Artificial Sequence
  derived and/or modified sequence opt2 from TLR1__Homo_sapiens__AAY85642
augaccuccaucuuccacuucgccaucaucuucaugcucauccuccagauccgcauccagcucuccgaggaguccgaguuccucgucgaccgcuccaagaacggccucauccacguccccaaggaccucucccagaagaccaccauccucaacaucucccagaacuacaucuccgagcucuggaccuccgacauccucucccucuccaagcuccgcauccucaucaucucccacaaccgcauccaguaccucgacaucuccgucuucaaguucaaccaggagcucgaguaccucgaccucucccacaacaagcucgucaagaucuccugccaccccaccgucaaccucaagcaccucgaccucuccuucaacgccuucgacgcccuccccaucugcaaggaguucggcaacaugucccagcucaaguuccucggccucuccaccacccaccucgagaaguccuccguccuccccaucgcccaccucaacaucuccaagguccuccucguccucggcgagaccuacggcgagaaggaggaccccgagggccuccaggacuucaacaccgagucccuccacaucgucuuccccaccaacaaggaguuccacuucauccucgacgucuccgucaagaccgucgccaaccucgagcucuccaacaucaagugcguccucgaggacaacaagugcuccuacuuccucuccauccucgccaagcuccagaccaaccccaagcucuccucccucacccucaacaacaucgagaccaccuggaacuccuucauccgcauccuccagcucgucuggcacaccaccgucugguacuucuccaucuccaacgucaagcuccagggccagcucgacuuccgcgacuucgacuacuccggcaccucccucaaggcccucuccauccuccaggucgucuccgacgucuucggcuucccccaguccuacaucuacgagaucuucuccaacaugaacaucaagaacuucaccgucuccggcacccgcaugguccacaugcucugccccuccaagaucucccccuuccuccaccucgacuucuccaacaaccuccucaccgacaccgucuucgagaacugcggccaccucaccgagcucgagacccucauccuccagaugaaccagcucaaggagcucuccaagaucgccgagaugaccacccagaugaagucccuccagcagcucgacaucucccagaacuccgucuccuacgacgagaagaagggcgacugcuccuggaccaagucccuccucucccucaacauguccuccaacauccucaccgacaccaucuuccgcugccuccccccccgcaucaagguccucgaccuccacuccaacaagaucaaguccauccccaagcaggucgucaagcucgaggcccuccaggagcucaacgucgccuucaacucccucaccgaccuccccggcugcggcuccuucuccucccucuccguccucaucaucgaccacaacuccgucucccaccccuccgccgacuucuuccaguccugccagaagaugcgcuccaucaaggccggcgacaaccccuuccagugcaccugcgagcucggcgaguucgucaagaacaucgaccaggucuccuccgagguccucgagggcuggcccgacuccuacaagugcgacuaccccgaguccuaccgcggcacccuccucaaggacuuccacauguccgagcucuccugcaacaucacccuccucaucgucaccaucgucgccaccaugcucguccucgccgucaccgucaccucccucugcaucuaccucgaccuccccugguaccuccgcauggucugccaguggacccagacccgccgccgcgcccgcaacaucccccucgaggagcuccagcgcaaccuccaguuccacgccuucaucuccuacuccggccacgacuccuucugggucaagaacgagcuccuccccaaccucgagaaggagggcaugcagaucugccuccacgagcgcaacuucguccccggcaaguccaucgucgagaacaucaucaccugcaucgagaaguccuacaaguccaucuucguccucucccccaacuucguccaguccgaguggugccacuacgagcucuacuucgcccaccacaaccucuuccacgagggcuccaacucccucauccucauccuccucgagcccaucccccaguacuccauccccuccuccuaccacaagcucaagucccucauggcccgccgcaccuaccucgaguggcccaaggagaaguccaagcgcggccucuucugggccaaccuccgcgccgccaucaacaucaagcucaccgagcaggccaagaaguga

SEQ ID NO: 9547 - RNA, 2361 nt, Artificial Sequence
  derived and/or modified sequence opt3 from TLR1__Homo_sapiens__AAY85642
augaccagcaucuuccacuuugccauuauauucaugcugauccuccagauuagaauccaacuuuccgaggaaucugaguuucugguggacaggucaaagaacggcuugauucauguccccaaagauuuaagucagaagacaacuauccugaauauaagccagaacuacaucuccgaacuauggacgucugacauucucucgcugucaaaacuucggauccugauuaucagccacaaucgcauacaguauuuggauauuaguguuuucaaguuuaaccaagagcucgaauaccuggaccugucccauaauaaacucgugaagaucucuugccacccuaccguaaacuuaaagcaucuggaucuuagcuucaaugcuuuugacgcauugccaauuuguaaagaguucgggaacaugucccagcugaaguuucuaggacucucaacaacucaccuggagaaaaguagcgugcuuccgaucgcccaccugaauaucucuaaggucuugcucgugcugggugaaaccuauggcgagaaagaagaucccgagggguuacaggacuucaacacagagucccugcauauuguuuuuccuaccaauaaggaguuccacuuuauacucgaugugucagucaagacuguggcgaaccuugaacugagcaauaucaaaugcguauuggaagacaacaaguguaguuacuuccuaucuauucuggcuaaacuccagacaaauccaaagcuguccagccuuacccugaacaacaucgagacgacuuggaauaguuucauacgaauuuugcaacucguuuggcauaccacagugugguauuuuucuaucuccaacgucaaacugcagggacaguuagauuuccgugacuuugauuacucaggcacuucgcugaaggcccuaagcauccuccaggugguguccgacgucuucgguuuuccccaaucuuauauuuacgaaaucuucagcaauaugaacauuaaaaauuuuaccguuucagggacaagaauggugcacaugcugugcccuaguaagauauccccauuccuucacuuggacuuuagcaacaaucugcucaccgauacgguauucgagaacuguggacaucugacugagcuugaaacacugaucuugcagaugaaucagcucaaggagcugucuaaaauugcagaaaugaccacucaaaugaagucauuacagcagcuggacaucagucagaacagcguguccuacgaugagaaaaagggcgacugcucuuggacaaaaucgcuacucagccugaauauguccucaaacauccuuaccgauacgauuuuuagguguuugcccccucggauaaagguccuggaccuccacaguaauaagaucaaaucuauuccaaagcaagugguuaaacuggaagccuuacaggagcugaacguggcuuucaauagccuuaccgauuugccgggcugcggguccuuuucaagccucucuguccugaucauugaccauaacuccgugagucaccccagcgcagauuucuuccagucuugucagaagaugcgcuccaucaaagccggagacaacccuuuucaaugcacaugugagcuaggugaguucguaaagaauauagaucagguuucaagugaagugcuggaaggcuggccagacagcuauaagugcgacuaccccgagucguauagagggacucuccugaaagauuuucauauguccgaacuuucuugcaacaucaccuugcugauugucacaaucguggcuacuauguuaguccucgccgugaccguuacaagccuguguauuuaccuugaccugccuugguauuugaggauggugugccaguggacccagacucggcgccgagcgagaaauaucccacucgaggagcugcaaaggaaccuacaguuccacgcauuuauaucauacaguggacacgauuccuucuggguaaagaaugaacugcuccccaaccuggagaaagaaggcaugcagauuugucuucaugagcggaauuuugucccggguaagucuaucguggagaacauuaucacgugcauagagaaaagcuauaaguccaucuucguuuugucaccuaauuuugugcagagcgaauggugucacuacgaacuguacuucgcccaucacaacuuauuucacgaggggaguaauucucucauucugauccuucuggaacccauuccacaauauuccaucccuagcucguaccauaagcuaaaaucacucauggcucgucgcacauaucuggaguggcccaaggagaaaucuaagagaggauuguucugggccaaccugagggcagcuauaaauauuaaauuaaccgaacaggccaagaaauga

SEQ ID NO: 9548 - RNA, 2361 nt, Artificial Sequence
  derived and/or modified sequence opt4 from TLR1__Homo_sapiens__AAY85642
augaccagcaucuuccacuucgccaucaucuucaugcugauccugcagaucagaauccagcugagcgaggagagcgaguuccugguggacagaagcaagaacggccugauccacgugcccaaggaccugagccagaagaccaccauccugaacaucagccagaacuacaucagcgagcuguggaccagcgacauccugagccugagcaagcugagaauccugaucaucagccacaacagaauccaguaccuggacaucagcguguucaaguucaaccaggagcuggaguaccuggaccugagccacaacaagcuggugaagaucagcugccaccccaccgugaaccugaagcaccuggaccugagcuucaacgccuucgacgcccugcccaucugcaaggaguucggcaacaugagccagcugaaguuccugggccugagcaccacccaccuggagaagagcagcgugcugcccaucgcccaccugaacaucagcaaggugcugcuggugcugggcgagaccuacggcgagaaggaggaccccgagggccugcaggacuucaacaccgagagccugcacaucguguuccccaccaacaaggaguuccacuucauccuggacgugagcgugaagaccguggccaaccuggagcugagcaacaucaagugcgugcuggaggacaacaagugcagcuacuuccugagcauccuggccaagcugcagaccaaccccaagcugagcagccugacccugaacaacaucgagaccaccuggaacagcuucaucagaauccugcagcugguguggcacaccaccgugugguacuucagcaucagcaacgugaagcugcagggccagcuggacuucagagacuucgacuacagcggcaccagccugaaggcccugagcauccugcagguggugagcgacguguucggcuucccccagagcuacaucuacgagaucuucagcaacaugaacaucaagaacuucaccgugagcggcaccagaauggugcacaugcugugccccagcaagaucagccccuuccugcaccuggacuucagcaacaaccugcugaccgacaccguguucgagaacugcggccaccugaccgagcuggagacccugauccugcagaugaaccagcugaaggagcugagcaagaucgccgagaugaccacccagaugaagagccugcagcagcuggacaucagccagaacagcgugagcuacgacgagaagaagggcgacugcagcuggaccaagagccugcugagccugaacaugagcagcaacauccugaccgacaccaucuucagaugccugccccccagaaucaaggugcuggaccugcacagcaacaagaucaagagcauccccaagcagguggugaagcuggaggcccugcaggagcugaacguggccuucaacagccugaccgaccugcccggcugcggcagcuucagcagccugagcgugcugaucaucgaccacaacagcgugagccaccccagcgccgacuucuuccagagcugccagaagaugagaagcaucaaggccggcgacaaccccuuccagugcaccugcgagcugggcgaguucgugaagaacaucgaccaggugagcagcgaggugcuggagggcuggcccgacagcuacaagugcgacuaccccgagagcuacagaggcacccugcugaaggacuuccacaugagcgagcugagcugcaacaucacccugcugaucgugaccaucguggccaccaugcuggugcuggccgugaccgugaccagccugugcaucuaccuggaccugcccugguaccugagaauggugugccaguggacccagaccagaagaagagccagaaacaucccccuggaggagcugcagagaaaccugcaguuccacgccuucaucagcuacagcggccacgacagcuucugggugaagaacgagcugcugcccaaccuggagaaggagggcaugcagaucugccugcacgagagaaacuucgugcccggcaagagcaucguggagaacaucaucaccugcaucgagaagagcuacaagagcaucuucgugcugagccccaacuucgugcagagcgaguggugccacuacgagcuguacuucgcccaccacaaccuguuccacgagggcagcaacagccugauccugauccugcuggagcccaucccccaguacagcauccccagcagcuaccacaagcugaagagccugauggccagaagaaccuaccuggaguggcccaaggagaagagcaagagaggccuguucugggccaaccugagagccgccaucaacaucaagcugaccgagcaggccaagaaguga

SEQ ID NO: 9549 - RNA, 2361 nt, Artificial Sequence
  derived and/or modified sequence opt5 from TLR1__Homo_sapiens__AAY85642
augaccagcaucuuccacuuugccauuaucuucaugcugauucuccagauccggauucaacuguccgaggaaucugaguuucuuguggacagaagcaagaacggccugauccauguccccaaagaucucucccagaagacaacgauccugaauauuucucagaacuacaucagcgaacuuuggaccuccgacauucugucucucagcaaacugcgcauccugauuaucucccacaauagaauccaguaucucgauauuagcguuuucaaguuuaaccaagagcuggaauaccuugaccugucucauaauaaacucgugaagaucuccugccacccuacagugaaccugaagcaucuugaucugagcuucaaugcuuuugacgcccucccgauuuguaaagaguucgggaacaugucucagcugaaguuucugggacucuccaccacacaccuggagaaaagcucuguccuucccaucgcgcaccugaauauuuccaaggugcuccugguucuuggcgaaaccuauggggagaaagaagauccugagggacugcaggacuucaacacagagagccuccauaucguguuucccaccaauaaggaguuccacuuuauucuggaugucuccgugaagacgguugcuaaccuggaacucucuaauaucaaaugcgugcuggaagacaacaaguguagcuacuuccuuuccauccuggccaaacuccagaccaauccuaagcugagcucucuuacacugaacaacauugagaccacauggaacuccuucauccggauucuccaacuggucuggcauaccacggugugguauuuuagcaucucuaaugugaaacugcagggccagcucgauuuccgcgacuuugauuacagcgggacaucccugaaggcccuuucuauucugcaggucguuagcgacguguucggauuuccccaauccuauaucuacgaaaucuucagcaauaugaacauuaaaaauuuuaccgugucuggcacaagaaugguccacaugcucugcccuuccaagaucagcccguuccugcaccuggacuuuucuaacaaucuucucaccgauaccguguucgagaacuguggccaucugacagagcuggaaacgcucauucugcagaugaaucagcuuaaggagcuguccaaaaucgcugaaaugaccacacaaaugaaaagccuccagcagcuggacauuucccagaacucuguuagcuacgaugagaaaaagggggacugcuccuggaccaaaucucugcuuagccucaauauguccagcaacauccugacagauaccauuuuucggugucugcccccucgcaucaaggugcucgaccugcacucuaauaagaucaaauccauucccaagcaagucgugaaacuugaagcccugcaggagcucaacguugcuuucaauagccugacggaucugccuggaugcggcucuuuuuccagccuuucugugcucaucauugaccauaacagcgucucccaccccagcgccgauuucuuccagucuugucagaagaugagauccaucaaagcgggggacaacccguuucaaugcacaugugagcugggagaguucgugaagaauauugaucaggucagcuccgaagugcuggaaggcuggccugacucuuauaagugcgacuaccccgagagcuaucgggggacccuccugaaagauuuucauauguccgaacuuucuugcaacaucacccugcucaucguuacaauuguggccaccaugcugguccuggcugugacaguuacgagccuuuguaucuaccucgaccugccuugguaucugcgcauggugugccaguggacccagacaagacggcgcgccagaaauauuccccucgaggagcugcaacggaaccuucaguuccacgcuuuuaucuccuacucuggacacgauagcuucugggucaagaaugaacugcuccccaaccuggagaaagaaggcaugcagauuugucugcaugagcgcaauuuugugccuggcaaguccaucguggagaacaucauuaccugcaucgaaaagagcuauaagucuauuuucguucuuuccccgaauuuuguccagagcgaguggugucacuacgaacuguacuucgcccaucacaaccucuuucacgaggggucuaauucccugauccucauucugcuugaacccaucccucaauauagcauccccucuuccuaccauaagcugaaaagccucauggcgagacggacauaucuggaguggccuaaggagaaauccaagagaggacuguucugggccaaccuucgcgcugccauuaauaucaaacugaccgaacaggcuaagaaauga

SEQ ID NO: 9550 - protein, 786 aa, Artificial Sequence [sequence omitted]

SEQ ID NO: 9551 - RNA, 2361 nt, Artificial Sequence
  TLR1__Homo_sapiens__AAY85643
augacuagcaucuuccauuuugccauuaucuucauguuaauacuucagaucagaauacaauuaucugaagaaagugaauuuuuaguugauaggucaaaaaacggucucauccacguuccuaaagaccuaucccagaaaacaacaaucuuaaauauaucgcaaaauuauaugucugagcuuuggacuucugacaucuuaucacugucaaaacugaggauuuugauaauuucucauaauagaauccaguaucuugauaucaguguuuucaaauucaaccaggaauuggaauacuuggauuugucccacaacaaguuggugaagauuucuugccacccuacugugaaccucaagcacuuggaccugucauuuaaugcauuugaugcccugccuauaugcaaagaguuuggcaauaugucucaacuaaaauuucugggguugagcaccacacacuuagaaaaaucuagugugcugccaauugcucauuugaauaucagcaaggucuugcuggucuuaggagagacuuauggggaaaaagaagacccugagggccuucaagacuuuaacacugagagucugcacauuguguuccccacaaacaaagaauuccauuuuauuuuggaugugucagucaagacuguagcaaaucuggaacuaucuaauaucaaaugugugcuagaagauaacaaauguucuuacuuccuaaguauucuggcgaaacuucaaacaaauccaaaguuaucaagucuuaccuuaaacaacauugaaacaacuuggaauucuuucauuaggauccuccagcugguuuggcauacaacuguaugguauuucucaauuucaaacgugaagcuacagggucagcuggacuucagagauuuugauuauucuggcacuuccuugaaggccuugucuauacaccaaguugucagcgauguguucgguuuuccgcaaaguuauaucuaugaaaucuuuucgaauaugaacaucaaaaauuucacagugucugguacacgcaugguccacaugcuuugcccauccaaaauuagcccguuccugcauuuggauuuuuccaauaaucucuuaacagacacgguuuuugaaaauugugggcaccuuacugaguuggagacacuuauuuuacaaaugaaucaauuaaaagaacuuucaaaaauagcugaaaugacuacacagaugaagucucugcaacaauuggauauuagccagaauucuguaagcuaugaugaaaagaaaggagacuguucuuggacuaaaaguuuauuaaguuuaaauaugucuucaaauauacuuacugacacuauuuucagauguuuaccucccaggaucaagguacuugaucuucacagcaauaaaauaaagagcauuccuaaacaagucguaaaacuggaagcuuugcaagaacucaauguugcuuucaauucuuuaacugaccuuccuggauguggcagcuuuagcagccuuucuguauugaucauugaucacaauucaguuucccacccaucagcugauuucuuccagagcugccagaagaugaggucaauaaaagcaggggacaauccauuccaauguaccugugagcuaggagaauuugucaaaaauauagaccaaguaucaagugaaguguuagagggcuggccugauucuuauaagugugacuacccggaaaguuauagaggaacccuacuaaaggacuuucacaugucugaauuauccugcaacauaacucugcugaucgucaccaucguugccaccaugcugguguuggcugugacugugaccucccucugcaucuacuuggaucugcccugguaucucaggauggugugccaguggacccagacccggcgcagggccaggaacauacccuuagaagaacuccaaagaaaucuccaguuucaugcauuuauuucauauagugggcacgauucuuucugggugaagaaugaauuauugccaaaccuagagaaagaagguaugcagauuugccuucaugagagaaacuuuguuccuggcaagagcauuguggaaaauaucaucaccugcauugagaagaguuacaaguccaucuuuguuuugucucccaacuuuguccagagugaauggugccauuaugaacucuacuuugcccaucacaaucucuuucaugaaggaucuaauagcuuaauccugaucuugcuggaacccauuccgcaguacuccauuccuagcaguuaucacaagcucaaaagucucauggccaggaggacuuauuuggaauggcccaaggaaaagagcaaacguggccuuuuuugggcuaacuuaagggcagccauuaauauuaagcugacagagcaagcaaagaaauag

SEQ ID NO: 9552 - RNA, 2361 nt, Artificial Sequence
  derived and/or modified sequence opt1 from TLR1__Homo_sapiens__AAY85643
augaccagcaucuuccacuucgccaucaucuucaugcugauccuccagauccgcauccagcuguccgaggagagcgaguuccugguggaccgguccaagaacggccucauccacguccccaaggaccugagccagaagaccacgauccugaacaucucccagaacuacaugagcgagcucuggaccuccgacauccugagccuguccaagcuccgcauccugaucaucagccacaaccggauccaguaccuggacaucuccguguucaaguucaaccaggagcucgaguaccuggaccugagccacaacaagcucgugaagaucuccugccacccgaccgucaaccugaagcaccuggaccucagcuucaacgccuucgacgcgcugcccaucugcaaggaguucgggaacaugucccagcugaaguuccucggccugagcaccacgcaccuggagaaguccagcgugcuccccaucgcccaccugaacaucuccaaggugcugcucguccugggggagaccuacggcgagaaggaggaccccgaggggcugcaggacuucaacaccgagagccuccacaucguguucccgaccaacaaggaguuccacuucauccuggacgugagcgucaagacgguggccaaccuggagcucuccaacaucaagugcgugcuggaggacaacaagugcagcuacuuccuguccauccucgccaagcugcagaccaaccccaagcugagcucccucacccugaacaacaucgagaccacguggaacagcuucauccgcauccugcagcucgucuggcacaccaccgugugguacuucuccaucagcaacgugaagcugcagggccagcuggacuuccgggacuucgacuacuccggcaccagccucaaggcccuguccauccaccaggucgugagcgacguguucggguucccccaguccuacaucuacgagaucuucagcaacaugaacaucaagaacuucacggucuccggcacccgcauggugcacaugcugugccccagcaagaucuccccguuccuccaccuggacuucagcaacaaccugcugaccgacaccguguucgagaacugcgggcaccucacggagcuggagacccugauccuccagaugaaccagcugaaggagcuguccaagaucgcggagaugaccacccagaugaagucccuccagcagcuggacaucagccagaacagcgucagcuacgacgagaagaagggcgacugcuccuggaccaagagccugcucucccugaacaugagcuccaacauccugaccgacaccaucuuccggugccucccgccccgcaucaaggugcuggaccugcacagcaacaagaucaaguccauccccaagcaggucgugaagcucgaggcccugcaggagcugaacguggccuucaacagccucaccgaccugcccgggugcggcuccuucagcucccugagcguccucaucaucgaccacaacuccgugagccaccccuccgccgacuucuuccagagcugccagaagaugcggagcaucaaggcgggcgacaaccccuuccagugcacgugcgagcugggggaguucgugaagaacaucgaccaggucuccagcgaggugcuggagggcuggcccgacuccuacaagugcgacuacccggagagcuaccgcgggacccuccugaaggacuuccacauguccgagcugagcugcaacaucacccuccugaucgugaccaucgucgccacgaugcuggugcucgccgugaccgucaccucccugugcaucuaccuggaccuccccugguaccugcggauggugugccaguggacccagacgcgccggcgcgcccggaacaucccccuggaggagcuccagcgcaaccugcaguuccacgccuucaucagcuacuccggccacgacagcuucugggugaagaacgagcugcuccccaaccuggagaaggagggcaugcagaucugccugcacgagcggaacuucgucccggggaaguccaucguggagaacaucaucacgugcaucgagaaguccuacaagagcaucuucgugcucagccccaacuucguccaguccgaguggugccacuacgagcuguacuucgcgcaccacaaccuguuccacgagggcagcaacucccucauccugauccugcucgagcccaucccccaguacagcaucccguccagcuaccacaagcucaagagccugauggcccgccggaccuaccuggaguggcccaaggagaaguccaagcgcgggcuguucugggccaaccugcgggccgccaucaacaucaagcucaccgagcaggcgaagaaguga

SEQ ID NO: 9553 - RNA, 2361 nt, Artificial Sequence
  derived and/or modified sequence opt2 from TLR1__Homo_sapiens__AAY85643
augaccuccaucuuccacuucgccaucaucuucaugcucauccuccagauccgcauccagcucuccgaggaguccgaguuccucgucgaccgcuccaagaacggccucauccacguccccaaggaccucucccagaagaccaccauccucaacaucucccagaacuacauguccgagcucuggaccuccgacauccucucccucuccaagcuccgcauccucaucaucucccacaaccgcauccaguaccucgacaucuccgucuucaaguucaaccaggagcucgaguaccucgaccucucccacaacaagcucgucaagaucuccugccaccccaccgucaaccucaagcaccucgaccucuccuucaacgccuucgacgcccuccccaucugcaaggaguucggcaacaugucccagcucaaguuccucggccucuccaccacccaccucgagaaguccuccguccuccccaucgcccaccucaacaucuccaagguccuccucguccucggcgagaccuacggcgagaaggaggaccccgagggccuccaggacuucaacaccgagucccuccacaucgucuuccccaccaacaaggaguuccacuucauccucgacgucuccgucaagaccgucgccaaccucgagcucuccaacaucaagugcguccucgaggacaacaagugcuccuacuuccucuccauccucgccaagcuccagaccaaccccaagcucuccucccucacccucaacaacaucgagaccaccuggaacuccuucauccgcauccuccagcucgucuggcacaccaccgucugguacuucuccaucuccaacgucaagcuccagggccagcucgacuuccgcgacuucgacuacuccggcaccucccucaaggcccucuccauccaccaggucgucuccgacgucuucggcuucccccaguccuacaucuacgagaucuucuccaacaugaacaucaagaacuucaccgucuccggcacccgcaugguccacaugcucugccccuccaagaucucccccuuccuccaccucgacuucuccaacaaccuccucaccgacaccgucuucgagaacugcggccaccucaccgagcucgagacccucauccuccagaugaaccagcucaaggagcucuccaagaucgccgagaugaccacccagaugaagucccuccagcagcucgacaucucccagaacuccgucuccuacgacgagaagaagggcgacugcuccuggaccaagucccuccucucccucaacauguccuccaacauccucaccgacaccaucuuccgcugccuccccccccgcaucaagguccucgaccuccacuccaacaagaucaaguccauccccaagcaggucgucaagcucgaggcccuccaggagcucaacgucgccuucaacucccucaccgaccuccccggcugcggcuccuucuccucccucuccguccucaucaucgaccacaacuccgucucccaccccuccgccgacuucuuccaguccugccagaagaugcgcuccaucaaggccggcgacaaccccuuccagugcaccugcgagcucggcgaguucgucaagaacaucgaccaggucuccuccgagguccucgagggcuggcccgacuccuacaagugcgacuaccccgaguccuaccgcggcacccuccucaaggacuuccacauguccgagcucuccugcaacaucacccuccucaucgucaccaucgucgccaccaugcucguccucgccgucaccgucaccucccucugcaucuaccucgaccuccccugguaccuccgcauggucugccaguggacccagacccgccgccgcgcccgcaacaucccccucgaggagcuccagcgcaaccuccaguuccacgccuucaucuccuacuccggccacgacuccuucugggucaagaacgagcuccuccccaaccucgagaaggagggcaugcagaucugccuccacgagcgcaacuucguccccggcaaguccaucgucgagaacaucaucaccugcaucgagaaguccuacaaguccaucuucguccucucccccaacuucguccaguccgaguggugccacuacgagcucuacuucgcccaccacaaccucuuccacgagggcuccaacucccucauccucauccuccucgagcccaucccccaguacuccauccccuccuccuaccacaagcucaagucccucauggcccgccgcaccuaccucgaguggcccaaggagaaguccaagcgcggccucuucugggccaaccuccgcgccgccaucaacaucaagcucaccgagcaggccaagaaguga

SEQ ID NO: 9554 - RNA, 2361 nt, Artificial Sequence
  derived and/or modified sequence opt3 from TLR1__Homo_sapiens__AAY85643
augaccagcaucuuccacuuugccauuauauucaugcugauccuccagauuagaauccaacuuuccgaggaaucugaguuucugguggacaggucaaagaacggcuugauucauguccccaaagauuuaagucagaagacaacuauccugaauauaagccagaacuacauguccgaacuauggacgucugacauccucucgcugucaaaacuucggauucugaucauuagccacaaucgcauccaguauuuggauauaaguguuuucaaguuuaaccaagagcucgaauaccuggaccugucccauaauaaacucgugaagauuucuugccacccuaccguaaacuuaaagcaucuggaucuuagcuucaaugcuuuugacgcauugccaaucuguaaagaguucgggaacaugucccagcugaaguuucuaggacucucaacaacucaccuggagaaaaguagcgugcuuccgauugcccaccugaauaucucuaaggucuugcucgugcugggugaaaccuauggcgagaaagaagaucccgagggguuacaggacuucaacacagagucccugcauaucguuuuuccuaccaauaaggaguuccacuuuauucucgaugugucagucaagacuguggcgaaccuugaacugagcaauauaaaaugcguauuggaagacaacaaguguaguuacuuccuaucuauccuggcuaaacuccagacaaauccaaagcuguccagccuuacccugaacaacauugagacgacuuggaauagcuucauccgaauauugcaacucguuuggcauaccacagugugguauuuuucuauuuccaacgucaaacugcagggacaguuagauuuccgugacuuugauuacucaggcacuucacugaaggcccuaagcauccaccaggugguguccgacgucuucgguuuuccccaaucuuauaucuacgaaauuuucagcaauaugaacaucaaaaauuuuaccguuucagggacaagaauggugcacaugcucugcccuaguaagauuuccccauuccugcaucuugacuuuagcaacaauuugcugaccgauacgguauucgagaacuguggacaccucacugagcuggaaacacuuauacugcagaugaaucaguugaaggagcucucuaaaaucgcagaaaugaccacucaaaugaagucacugcagcaguuagacauuagucagaacagcguguccuacgaugagaaaaagggcgacugcucuuggacaaaaucgcugcuaagccucaauauguccucaaacauccugaccgauacgaucuuuaggugucuucccccucggauuaaggucuuggaccugcauaguaauaagauaaaaucuaucccaaagcaagugguuaaacucgaagcccugcaggaguuaaacguggcuuucaauagccugaccgaucuuccgggcugcggguccuuuaguagcuugucuguccucauuaucgaccacaacuccgugagucaucccagcgcagauuucuuccagucuugucagaagaugcgcuccauuaaagccggagacaacccuuuucaaugcacaugugagcugggugaguucguaaagaauaucgaucagguuucaagugaagugcuagaaggcuggccagacagcuauaagugcgacuaccccgagucguauagagggacucugcucaaagauuuucacauguccgaacugucuugcaacauaacccuuuugaucgucacaauuguggcuacuaugcuggucuuagccgugaccguuacaagccucuguaucuaccuggaccuuccuugguaucugaggauggugugccaguggacccagacucggcgccgagcgagaaauauuccauuggaggagcuccaaaggaaccugcaguuccacgcauuuaucucauacaguggacaugauuccuucuggguaaagaaugaacuacugcccaaccucgagaaagaaggcaugcagauaugucugcacgagcggaauuuugucccggguaagucuauuguggagaacaucauuacgugcaucgaaaaaucguauaaguccauauucguucuuucaccuaauuuugugcagagcgaguggugucauuacgaauuguacuucgcccaccacaaccuguuucaugaggggaguaauucuuuaauccucauucugcuugaacccaucccacaauauuccauuccuagcucguaccacaagcugaaaucacuaauggcucgucgcacauaucucgaguggcccaaggagaaaucuaagagaggacuguucugggccaacuugagggcagcuaucaauauaaaacugaccgaacaggccaagaaauga

SEQ ID NO: 9555 - RNA, 2361 nt, Artificial Sequence
  derived and/or modified sequence opt4 from TLR1__Homo_sapiens__AAY85643
augaccagcaucuuccacuucgccaucaucuucaugcugauccugcagaucagaauccagcugagcgaggagagcgaguuccugguggacagaagcaagaacggccugauccacgugcccaaggaccugagccagaagaccaccauccugaacaucagccagaacuacaugagcgagcuguggaccagcgacauccugagccugagcaagcugagaauccugaucaucagccacaacagaauccaguaccuggacaucagcguguucaaguucaaccaggagcuggaguaccuggaccugagccacaacaagcuggugaagaucagcugccaccccaccgugaaccugaagcaccuggaccugagcuucaacgccuucgacgcccugcccaucugcaaggaguucggcaacaugagccagcugaaguuccugggccugagcaccacccaccuggagaagagcagcgugcugcccaucgcccaccugaacaucagcaaggugcugcuggugcugggcgagaccuacggcgagaaggaggaccccgagggccugcaggacuucaacaccgagagccugcacaucguguuccccaccaacaaggaguuccacuucauccuggacgugagcgugaagaccguggccaaccuggagcugagcaacaucaagugcgugcuggaggacaacaagugcagcuacuuccugagcauccuggccaagcugcagaccaaccccaagcugagcagccugacccugaacaacaucgagaccaccuggaacagcuucaucagaauccugcagcugguguggcacaccaccgugugguacuucagcaucagcaacgugaagcugcagggccagcuggacuucagagacuucgacuacagcggcaccagccugaaggcccugagcauccaccagguggugagcgacguguucggcuucccccagagcuacaucuacgagaucuucagcaacaugaacaucaagaacuucaccgugagcggcaccagaauggugcacaugcugugccccagcaagaucagccccuuccugcaccuggacuucagcaacaaccugcugaccgacaccguguucgagaacugcggccaccugaccgagcuggagacccugauccugcagaugaaccagcugaaggagcugagcaagaucgccgagaugaccacccagaugaagagccugcagcagcuggacaucagccagaacagcgugagcuacgacgagaagaagggcgacugcagcuggaccaagagccugcugagccugaacaugagcagcaacauccugaccgacaccaucuucagaugccugccccccagaaucaaggugcuggaccugcacagcaacaagaucaagagcauccccaagcagguggugaagcuggaggcccugcaggagcugaacguggccuucaacagccugaccgaccugcccggcugcggcagcuucagcagccugagcgugcugaucaucgaccacaacagcgugagccaccccagcgccgacuucuuccagagcugccagaagaugagaagcaucaaggccggcgacaaccccuuccagugcaccugcgagcugggcgaguucgugaagaacaucgaccaggugagcagcgaggugcuggagggcuggcccgacagcuacaagugcgacuaccccgagagcuacagaggcacccugcugaaggacuuccacaugagcgagcugagcugcaacaucacccugcugaucgugaccaucguggccaccaugcuggugcuggccgugaccgugaccagccugugcaucuaccuggaccugcccugguaccugagaauggugugccaguggacccagaccagaagaagagccagaaacaucccccuggaggagcugcagagaaaccugcaguuccacgccuucaucagcuacagcggccacgacagcuucugggugaagaacgagcugcugcccaaccuggagaaggagggcaugcagaucugccugcacgagagaaacuucgugcccggcaagagcaucguggagaacaucaucaccugcaucgagaagagcuacaagagcaucuucgugcugagccccaacuucgugcagagcgaguggugccacuacgagcuguacuucgcccaccacaaccuguuccacgagggcagcaacagccugauccugauccugcuggagcccaucccccaguacagcauccccagcagcuaccacaagcugaagagccugauggccagaagaaccuaccuggaguggcccaaggagaagagcaagagaggccuguucugggccaaccugagagccgccaucaacaucaagcugaccgagcaggccaagaaguga

SEQ ID NO: 9556 - RNA, 2361 nt, Artificial Sequence
  derived and/or modified sequence opt5 from TLR1__Homo_sapiens__AAY85643
augaccagcaucuuccacuuugccauuaucuucaugcugauucuccagaucagaauccaacuguccgaggaaucugaguuucuuguggaccggagcaagaacggccugauccauguccccaaagaucucucccagaagacaacgauccugaauauuucucagaacuacaugagcgaacuuuggaccuccgacauccugucucucagcaaacugcgcauucugaucauuucccacaauagaauccaguaucucgauauuagcguuuucaaguuuaaccaagagcuggaauaccuugaccugucucauaauaaacucgugaagaucuccugccacccuacagugaaccugaagcaucuugaucugagcuucaaugcuuuugacgcccucccgaucuguaaagaguucgggaacaugucucagcugaaguuucugggacucuccaccacacaccuggagaaaagcucuguccuucccauugcgcaccugaauaucuccaaggugcuccugguucuuggcgaaaccuauggggagaaagaagauccugagggacugcaggacuucaacacagagagccuccauauuguguuucccaccaauaaggaguuccacuuuauccuggaugucuccgugaagacgguugcuaaccuggaacucucuaauauuaaaugcgugcuggaagacaacaaguguagcuacuuccuuuccauccuggccaaacuccagaccaauccuaagcugagcucucuuacacugaacaacaucgagaccacauggaauagcuucauucggauccuccaacuggucuggcauaccacggugugguauuuuagcauuucuaacgugaaacugcagggccagcucgauuuccgcgacuuugauuacagcgggacaucccugaaggcccuuucuauccaccaggucguuagcgacguguucggauuuccccaauccuauauuuacgaaaucuucagcaauaugaacaucaaaaauuuuaccgugucuggcacaagaaugguccacaugcugugcccuuccaagauuagcccguuccuccaucuggacuuuucuaacaaucugcuuaccgauaccguguucgagaacuguggccaccucacagagcuggaaacgcugauccuccagaugaaucagcugaaggagcuuuccaaaauugcugaaaugaccacacaaaugaagucccugcagcagcucgacaucucccagaacucuguuagcuacgaugagaaaaagggggacugcuccuggaccaaaucucugcugagccuuaauauguccagcaacauucucacagauaccaucuuucggugucugcccccucgcauuaaggugcuggaccuccauucuaauaagaucaaauccauccccaagcaagucgugaaacuggaagcccuucaggagcugaacguugcuuucaauagccucacggaucugccuggaugcggcucuuuuuccagccugucugugcuuauuaucgaccacaacagcgucucccaucccagcgccgauuucuuccagucuugucagaagaugagauccauuaaagcgggggacaacccguuucaaugcacaugugagcucggagaguucgugaagaauaucgaucaggucagcuccgaagugcuggaaggcuggccugacucuuauaagugcgacuaccccgagagcuaucgggggacccugcucaaagauuuucacauguccgaacugucuugcaacauuacccuucugaucguuacaaucguggccaccaugcucguccuggcugugacaguuacgagccuguguauuuaccuugaccucccuugguaucugcgcauggugugccaguggacccagacaagacggcgcgccagaaauaucccccuggaggagcuccaacggaaccugcaguuccacgcuuuuauuuccuacucuggacaugauagcuucugggucaagaaugaacuucugcccaaccucgagaaagaaggcaugcagaucugucugcacgagcgcaauuuugugccuggcaaguccauuguggagaacaucauuaccugcauugaaaagagcuauaagucuaucuucguucuguccccgaauuuuguccagagcgaguggugucauuacgaacuuuacuucgcccaccacaaccuguuucaugaggggucuaauucccucauucugauccuccuggaacccauuccucaauauagcauccccucuuccuaccacaaacuuaaaagccugauggcgagacggacauaucucgaguggccuaaggagaaauccaagagaggacuguucugggccaaccugcgcgcugccaucaauauuaaacuuaccgaacaggcuaagaaauga

SEQ ID NO: 9557 - protein, 786 aa, Artificial Sequence
  TLR1__Homo_sapiens__Q15399
MTSIFHFAIIFMLILQIRIQLSEESEFLVDRSKNGLIHVPKDLSQKTTILNISQNYISELWTSDILSLSKLRILIISHNRIQYLDISVFKFNQELEYLDLSHNKLVKISCHPTVNLKHLDLSFNAFDALPICKEFGNMSQLKFLGLSTTHLEKSSVLPIAHLNISKVLLVLGETYGEKEDPEGLQDFNTESLHIVFPTNKEFHFILDVSVKTVANLELSNIKCVLEDNKCSYFLSILAKLQTNPKLSNLTLNNIETTWNSFIRILQLVWHTTVWYFSISNVKLQGQLDFRDFDYSGTSLKALSIHQVVSDVFGFPQSYIYEIFSNMNIKNFTVSGTRMVHMLCPSKISPFLHLDFSNNLLTDTVFENCGHLTELETLILQMNQLKELSKIAEMTTQMKSLQQLDISQNSVSYDEKKGDCSWTKSLLSLNMSSNILTDTIFRCLPPRIKVLDLHSNKIKSIPKQVVKLEALQELNVAFNSLTDLPGCGSFSSLSVLIIDHNSVSHPSADFFQSCQKMRSIKAGDNPFQCTCELGEFVKNIDQVSSEVLEGWPDSYKCDYPESYRGTLLKDFHMSELSCNITLLIVTIVATMLVLAVTVTSLCSYLDLPWYLRMVCQWTQTRRRARNIPLEELQRNLQFHAFISYSGHDSFWVKNELLPNLEKEGMQICLHERNFVPGKSIVENIITCIEKSYKSIFVLSPNFVQSEWCHYELYFAHHNLFHEGSNSLILILLEPIPQYSIPSSYHKLKSLMARRTYLEWPKEKSKRGLFWANLRAAINIKLTEQAKK

SEQ ID NO: 9558 - RNA, 2361 nt, Artificial Sequence
  TLR1__Homo_sapiens__AAI09094
augacuagcaucuuccauuuugccauuaucuucauguuaauacuucagaucagaauacaauuaucugaagaaagugaauuuuuaguugauaggucaaaaaacggucucauccacguuccuaaagaccuaucccagaaaacaacaaucuuaaauauaucgcaaaauuauauaucugagcuuuggacuucugacaucuuaucacugucaaaacugaggauuuugauaauuucucauaauagaauccaguaucuugauaucaguguuuucaaauucaaccaggaauuggaauacuuggauuugucccacaacaaguuggugaagauuucuugccacccuacugugaaccucaagcacuuggaccugucauuuaaugcauuugaugcccugccuauaugcaaagaguuuggcaauaugucucaacuaaaauuucugggguugagcaccacacacuuagaaaaaucuagugugcugccaauugcucauuugaauaucagcaaggucuugcuggucuuaggagagacuuauggggaaaaagaagacccugagggccuucaagacuuuaacacugagagucugcacauuguguuccccacaaacaaagaauuccauuuuauuuuggaugugucagucaagacuguagcaaaucuggaacuaucuaauaucaaaugugugcuagaagauaacaaauguucuuacuuccuaaguauucuggcgaaacuucaaacaaauccaaaguuaucaaaucuuaccuuaaacaacauugaaacaacuuggaauucuuucauuaggauccuccagcugguuuggcauacaacuguaugguauuucucaauuucaaacgugaagcuacagggucagcuggacuucagagauuuugauuauucuggcacuuccuugaaggccuugucuauacaccaaguugucagcgauguguucgguuuuccgcaaaguuauaucuaugaaaucuuuucgaauaugaacaucaaaaauuucacagugucugguacacgcaugguccacaugcuuugcccauccaaaauuagcccguuccugcauuuggauuuuuccaauaaucucuuaacagacacgguuuuugaaaauugugggcaccuuacugaguuggagacacuuauuuuacaaaugaaucaauuaaaagaacuuucaaaaauagcugaaaugacuacacagaugaagucucugcaacaauuggauauuagccagaauucuguaagcuaugaugaaaagaaaggagacuguucuuggacuaaaaguuuauuaaguuuaaauaugucuucaaauauacuuacugacacuauuuucagauguuuaccucccaggaucaagguacuugaucuucacagcaauaaaauaaagagcauuccuaaacaagucguaaaacuggaagcuuugcaagaacucaauguugcuuucaauucuuuaacugaccuuccuggauguggcagcuuuagcagccuuucuguauugaucauugaucacaauucaguuucccacccaucggcugauuucuuccagagcugccagaagaugaggucaauaaaagcaggggacaauccauuccaauguaccugugagcuaggagaauuugucaaaaauauagaccaaguaucaagugaaguguuagagggcuggccugauucuuauaagugugacuacccggaaaguuauagaggaacccuacuaaaggacuuucacaugucugaauuauccugcaacauaacucugcugaucgucaccaucguugccaccaugcugguguuggcugugacugugaccucccucugcagcuacuuggaucugcccugguaucucaggauggugugccaguggacccagacccggcgcagggccaggaacauacccuuagaagaacuccaaagaaaucuccaguuucaugcauuuauuucauauagugggcacgauucuuucugggugaagaaugaauuauugccaaaccuagagaaagaagguaugcagauuugccuucaugagagaaacuuuguuccuggcaagagcauuguggaaaauaucaucaccugcauugagaagaguuacaaguccaucuuuguuuugucucccaacuuuguccagagugaauggugccauuaugaacucuacuuugcccaucacaaucucuuucaugaaggaucuaauagcuuaauccugaucuugcuggaacccauuccgcaguacuccauuccuagcaguuaucacaagcucaaaagucucauggccaggaggacuuauuuggaauggcccaaggaaaagagcaaacguggccuuuuuugggcuaacuuaagggcagccauuaauauuaagcugacagagcaagcaaagaaauag

SEQ ID NO: 9559 - RNA, 2361 nt, Artificial Sequence
  derived and/or modified sequence opt1 from TLR1__Homo_sapiens__AAI09094
augaccagcaucuuccacuucgccaucaucuucaugcugauccuccagauccgcauccagcuguccgaggagagcgaguuccugguggaccgguccaagaacggccucauccacguccccaaggaccugagccagaagaccaccauccugaacaucucccagaacuacaucagcgagcucuggaccuccgacauccugagccuguccaagcuccgcauccugaucaucagccacaaccggauccaguaccuggacaucuccguguucaaguucaaccaggagcucgaguaccuggaccugagccacaacaagcucgugaagaucuccugccacccgaccgucaaccugaagcaccuggaccucagcuucaacgccuucgacgcgcugcccaucugcaaggaguucgggaacaugucccagcugaaguuccucggccugagcaccacgcaccuggagaaguccagcgugcuccccaucgcccaccugaacaucuccaaggugcugcucguccugggggagaccuacggcgagaaggaggaccccgaggggcugcaggacuucaacaccgagagccuccacaucguguucccgaccaacaaggaguuccacuucauccuggacgugagcgucaagacgguggccaaccuggagcucuccaacaucaagugcgugcuggaggacaacaagugcagcuacuuccuguccauccucgccaagcugcagaccaaccccaagcugagcaaccucacccugaacaacaucgagaccacguggaacuccuucauccgcauccugcagcucgucuggcacaccaccgugugguacuucagcaucuccaacgugaagcugcagggccagcuggacuuccgggacuucgacuacagcggcaccucccucaaggcccugagcauccaccaggucguguccgacguguucggguucccccagagcuacaucuacgagaucuucuccaacaugaacaucaagaacuucacggucagcggcacccgcauggugcacaugcugugccccuccaagaucagcccguuccuccaccuggacuucuccaacaaccugcugaccgacaccguguucgagaacugcgggcaccucacggagcuggagacccugauccuccagaugaaccagcugaaggagcugagcaagaucgcggagaugaccacccagaugaagucccuccagcagcuggacaucagccagaacagcgucuccuacgacgagaagaagggcgacugcagcuggacgaagucccugcucagccugaacauguccagcaacauccugaccgacaccaucuuccggugccucccgccccgcaucaaggugcuggaccugcacuccaacaagaucaagagcauccccaagcaggucgugaagcucgaggcccugcaggagcugaacguggccuucaacucccucaccgaccugcccgggugcggcagcuucuccagccuguccguccucaucaucgaccacaacagcgugucccaccccagcgccgacuucuuccaguccugccagaagaugcggagcaucaaggcgggcgacaaccccuuccagugcacgugcgagcugggggaguucgugaagaacaucgaccaggucagcuccgaggugcuggagggcuggcccgacagcuacaagugcgacuacccggaguccuaccgcgggacccuccugaaggacuuccacaugagcgagcuguccugcaacaucacccuccugaucgugaccaucgucgccacgaugcuggugcucgccgugaccgucaccagccugugcuccuaccuggaccuccccugguaccugcggauggugugccaguggacccagacgcgccggcgcgcccggaacaucccccuggaggagcuccagcgcaaccugcaguuccacgccuucaucagcuacuccggccacgacagcuucugggugaagaacgagcugcuccccaaccuggagaaggagggcaugcagaucugccugcacgagcggaacuucgucccggggaaguccaucguggagaacaucaucacgugcaucgagaaguccuacaagagcaucuucgugcucagccccaacuucguccaguccgaguggugccacuacgagcuguacuucgcgcaccacaaccuguuccacgagggcagcaacucccucauccugauccugcucgagcccaucccccaguacagcaucccguccagcuaccacaagcucaagagccugauggcccgccggaccuaccuggaguggcccaaggagaaguccaagcgcgggcuguucugggccaaccugcgggccgccaucaacaucaagcucaccgagcaggcgaagaaguga

SEQ ID NO: 9560 - RNA, 2361 nt, Artificial Sequence
  derived and/or modified sequence opt2 from TLR1__Homo_sapiens__AAI09094
augaccuccaucuuccacuucgccaucaucuucaugcucauccuccagauccgcauccagcucuccgaggaguccgaguuccucgucgaccgcuccaagaacggccucauccacguccccaaggaccucucccagaagaccaccauccucaacaucucccagaacuacaucuccgagcucuggaccuccgacauccucucccucuccaagcuccgcauccucaucaucucccacaaccgcauccaguaccucgacaucuccgucuucaaguucaaccaggagcucgaguaccucgaccucucccacaacaagcucgucaagaucuccugccaccccaccgucaaccucaagcaccucgaccucuccuucaacgccuucgacgcccuccccaucugcaaggaguucggcaacaugucccagcucaaguuccucggccucuccaccacccaccucgagaaguccuccguccuccccaucgcccaccucaacaucuccaagguccuccucguccucggcgagaccuacggcgagaaggaggaccccgagggccuccaggacuucaacaccgagucccuccacaucgucuuccccaccaacaaggaguuccacuucauccucgacgucuccgucaagaccgucgccaaccucgagcucuccaacaucaagugcguccucgaggacaacaagugcuccuacuuccucuccauccucgccaagcuccagaccaaccccaagcucuccaaccucacccucaacaacaucgagaccaccuggaacuccuucauccgcauccuccagcucgucuggcacaccaccgucugguacuucuccaucuccaacgucaagcuccagggccagcucgacuuccgcgacuucgacuacuccggcaccucccucaaggcccucuccauccaccaggucgucuccgacgucuucggcuucccccaguccuacaucuacgagaucuucuccaacaugaacaucaagaacuucaccgucuccggcacccgcaugguccacaugcucugccccuccaagaucucccccuuccuccaccucgacuucuccaacaaccuccucaccgacaccgucuucgagaacugcggccaccucaccgagcucgagacccucauccuccagaugaaccagcucaaggagcucuccaagaucgccgagaugaccacccagaugaagucccuccagcagcucgacaucucccagaacuccgucuccuacgacgagaagaagggcgacugcuccuggaccaagucccuccucucccucaacauguccuccaacauccucaccgacaccaucuuccgcugccuccccccccgcaucaagguccucgaccuccacuccaacaagaucaaguccauccccaagcaggucgucaagcucgaggcccuccaggagcucaacgucgccuucaacucccucaccgaccuccccggcugcggcuccuucuccucccucuccguccucaucaucgaccacaacuccgucucccaccccuccgccgacuucuuccaguccugccagaagaugcgcuccaucaaggccggcgacaaccccuuccagugcaccugcgagcucggcgaguucgucaagaacaucgaccaggucuccuccgagguccucgagggcuggcccgacuccuacaagugcgacuaccccgaguccuaccgcggcacccuccucaaggacuuccacauguccgagcucuccugcaacaucacccuccucaucgucaccaucgucgccaccaugcucguccucgccgucaccgucaccucccucugcuccuaccucgaccuccccugguaccuccgcauggucugccaguggacccagacccgccgccgcgcccgcaacaucccccucgaggagcuccagcgcaaccuccaguuccacgccuucaucuccuacuccggccacgacuccuucugggucaagaacgagcuccuccccaaccucgagaaggagggcaugcagaucugccuccacgagcgcaacuucguccccggcaaguccaucgucgagaacaucaucaccugcaucgagaaguccuacaaguccaucuucguccucucccccaacuucguccaguccgaguggugccacuacgagcucuacuucgcccaccacaaccucuuccacgagggcuccaacucccucauccucauccuccucgagcccaucccccaguacuccauccccuccuccuaccacaagcucaagucccucauggcccgccgcaccuaccucgaguggcccaaggagaaguccaagcgcggccucuucugggccaaccuccgcgccgccaucaacaucaagcucaccgagcaggccaagaaguga

SEQ ID NO: 9561 - RNA, 2361 nt, Artificial Sequence
  derived and/or modified sequence opt3 from TLR1__Homo_sapiens__AAI09094
augaccagcaucuuccacuuugccauuauauucaugcugauccuccagauuagaauccaacuuuccgaggaaucugaguuucugguggacaggucaaagaacggcuugauucauguccccaaagauuuaagucagaagacaacuauccugaauauaagccagaacuacaucuccgaacuauggacgucugacauucucucgcugucaaaacuucggauccugauuaucagccacaaucgcauacaguauuuggauauuaguguuuucaaguuuaaccaagagcucgaauaccuggaccugucccauaauaaacucgugaagaucucuugccacccuaccguaaacuuaaagcaucuggaucuuagcuucaaugcuuuugacgcauugccaauuuguaaagaguucgggaacaugucccagcugaaguuucuaggacucucaacaacucaccuggagaaaaguagcgugcuuccgaucgcccaccugaauaucucuaaggucuugcucgugcugggugaaaccuauggcgagaaagaagaucccgagggguuacaggacuucaacacagagucccugcauauuguuuuuccuaccaauaaggaguuccacuuuauacucgaugugucagucaagacuguggcgaaccuugaacugagcaauaucaaaugcguauuggaagacaacaaguguaguuacuuccuaucuauucuggcuaaacuccagacaaauccaaagcuguccaaccuuacccugaacaauaucgagacgacuuggaacagcuucauacgaauuuugcaacucguuuggcauaccacagugugguauuuuucgaucucuaaugucaaacugcagggacaguuagauuuccgugacuuugauuacuccggcacuucacugaaggcccuaaguauccaccagguggugagcgacgucuucgguuuuccccaauccuauauuuacgaaaucuucucuaacaugaauauuaaaaacuuuaccguuagcgggacaagaauggugcacaugcucugcccuucaaagauaaguccauuccugcaucuugacuuuuccaauaacuugcugaccgauacgguauucgagaauuguggacaccucacugagcuggaaacacuuauccugcagaugaaccaguugaaggagcucagcaaaauugcagaaaugaccacucaaaugaagucucugcagcaguuagacaucucacagaauagugugagcuacgaugagaaaaagggcgacugcuccuggacaaaaucucugcuaucgcucaacaugagcuccaauauccugaccgauacgauuuuuaggugucuucccccucggauaaaggucuuggaccugcauucaaacaagaucaaaaguauuccaaagcaagugguuaaacucgaagcccugcaggaguuaaauguggcuuucaacucucugaccgaucuuccgggcugcgggagcuuuuccucauugagcguccucaucauugaccacaacucugugucccaucccagugcagauuucuuccagagcugucagaagaugcgcucuaucaaagccggagacaauccuuuucaaugcacaugugagcugggugaguucguaaagaacauagaucagguuuccucagaagugcuagaaggcuggccagacaguuauaagugcgacuaccccgagagcuauagagggacucugcucaaagauuuucacaugucggaacuguccugcaauaucacccuuuugauugucacaaucguggcuacuaugcuggucuuagccgugaccguuacaucucucuguagcuaccuggaccuuccuugguaucugaggauggugugccaguggacccagacucggcgccgagcgagaaacauuccauuggaggagcuccaaaggaaucugcaguuccacgcauuuaucucauacaguggacaugauuccuucuggguaaagaacgaacuacugcccaaucucgagaaagaaggcaugcagauaugucugcacgagcggaacuuugucccggguaagucuauuguggagaauaucauuacgugcaucgagaaaagcuauaaguccauauucguucuuucaccuaacuuugugcagagcgaauggugucauuacgaauuguacuucgcccaccacaaucuguuucaugaggggaguaacucuuuaauccucauucugcuugaacccaucccacaauauuccauuccuagcucguaccacaagcugaaaucacuaauggcucgucgcacauaucucgaguggcccaaggagaaaucuaagagaggacuguucugggccaauuugagggcagcuaucaacauaaaacugaccgaacaggccaagaaauga

SEQ ID NO: 9562 - RNA, 2361 nt, Artificial Sequence
  derived and/or modified sequence opt4 from TLR1__Homo_sapiens__AAI09094
augaccagcaucuuccacuucgccaucaucuucaugcugauccugcagaucagaauccagcugagcgaggagagcgaguuccugguggacagaagcaagaacggccugauccacgugcccaaggaccugagccagaagaccaccauccugaacaucagccagaacuacaucagcgagcuguggaccagcgacauccugagccugagcaagcugagaauccugaucaucagccacaacagaauccaguaccuggacaucagcguguucaaguucaaccaggagcuggaguaccuggaccugagccacaacaagcuggugaagaucagcugccaccccaccgugaaccugaagcaccuggaccugagcuucaacgccuucgacgcccugcccaucugcaaggaguucggcaacaugagccagcugaaguuccugggccugagcaccacccaccuggagaagagcagcgugcugcccaucgcccaccugaacaucagcaaggugcugcuggugcugggcgagaccuacggcgagaaggaggaccccgagggccugcaggacuucaacaccgagagccugcacaucguguuccccaccaacaaggaguuccacuucauccuggacgugagcgugaagaccguggccaaccuggagcugagcaacaucaagugcgugcuggaggacaacaagugcagcuacuuccugagcauccuggccaagcugcagaccaaccccaagcugagcaaccugacccugaacaacaucgagaccaccuggaacagcuucaucagaauccugcagcugguguggcacaccaccgugugguacuucagcaucagcaacgugaagcugcagggccagcuggacuucagagacuucgacuacagcggcaccagccugaaggcccugagcauccaccagguggugagcgacguguucggcuucccccagagcuacaucuacgagaucuucagcaacaugaacaucaagaacuucaccgugagcggcaccagaauggugcacaugcugugccccagcaagaucagccccuuccugcaccuggacuucagcaacaaccugcugaccgacaccguguucgagaacugcggccaccugaccgagcuggagacccugauccugcagaugaaccagcugaaggagcugagcaagaucgccgagaugaccacccagaugaagagccugcagcagcuggacaucagccagaacagcgugagcuacgacgagaagaagggcgacugcagcuggaccaagagccugcugagccugaacaugagcagcaacauccugaccgacaccaucuucagaugccugccccccagaaucaaggugcuggaccugcacagcaacaagaucaagagcauccccaagcagguggugaagcuggaggcccugcaggagcugaacguggccuucaacagccugaccgaccugcccggcugcggcagcuucagcagccugagcgugcugaucaucgaccacaacagcgugagccaccccagcgccgacuucuuccagagcugccagaagaugagaagcaucaaggccggcgacaaccccuuccagugcaccugcgagcugggcgaguucgugaagaacaucgaccaggugagcagcgaggugcuggagggcuggcccgacagcuacaagugcgacuaccccgagagcuacagaggcacccugcugaaggacuuccacaugagcgagcugagcugcaacaucacccugcugaucgugaccaucguggccaccaugcuggugcuggccgugaccgugaccagccugugcagcuaccuggaccugcccugguaccugagaauggugugccaguggacccagaccagaagaagagccagaaacaucccccuggaggagcugcagagaaaccugcaguuccacgccuucaucagcuacagcggccacgacagcuucugggugaagaacgagcugcugcccaaccuggagaaggagggcaugcagaucugccugcacgagagaaacuucgugcccggcaagagcaucguggagaacaucaucaccugcaucgagaagagcuacaagagcaucuucgugcugagccccaacuucgugcagagcgaguggugccacuacgagcuguacuucgcccaccacaaccuguuccacgagggcagcaacagccugauccugauccugcuggagcccaucccccaguacagcauccccagcagcuaccacaagcugaagagccugauggccagaagaaccuaccuggaguggcccaaggagaagagcaagagaggccuguucugggccaaccugagagccgccaucaacaucaagcugaccgagcaggccaagaaguga

SEQ ID NO: 9563 - RNA, 2361 nt, Artificial Sequence
  derived and/or modified sequence opt5 from TLR1__Homo_sapiens__AAI09094
augaccagcaucuuccacuuugccauuaucuucaugcugauucuccagauccggauucaacuguccgaggaaucugaguuucuuguggacagaagcaagaacggccugauccauguccccaaagaucucucccagaagacaacgauccugaauauuucucagaacuacaucagcgaacuuuggaccuccgacauucugucucucagcaaacugcgcauccugauuaucucccacaauagaauccaguaucucgauaucagcguuuucaaguuuaaccaagagcuggaauaccuugaccugucucauaauaaacucgugaagaucuccugccacccuacagugaaccugaagcaucuugaucugagcuucaaugcuuuugacgcccucccgauuuguaaagaguucgggaacaugucucagcugaaguuucugggacucuccaccacacaccuggagaaaagcucuguccuucccaucgcgcaccugaauauuuccaaggugcuccugguucuuggcgaaaccuauggggagaaagaagauccugagggacugcaggacuucaacacagagagccuccauaucguguuucccaccaauaaggaguuccacuuuauucuggaugucuccgugaagacgguugcuaaccuggaacucucuaauaucaaaugcgugcuggaagacaacaaguguagcuacuuccuuuccauccuggccaaacuccagaccaauccuaagcugagcaaccuuacacugaacaauauugagaccacauggaacucuuucauccggauucuccaacuggucuggcauaccacggugugguauuuuuccaucagcaaugugaaacugcagggccagcucgauuuccgcgacuuugauuacucugggacaagccugaaggcccuuuccauucaccaggucguuucugacguguucggauuuccccaaagcuauaucuacgaaaucuucuccaacaugaauauuaaaaacuuuaccgugagcggcacaagaaugguccacaugcugugcccuucuaagaucuccccguuccuccaucuggacuuuagcaauaaccugcuuaccgauaccguguucgagaauuguggccaccucacagagcuggaaacgcugauucuccagaugaaccagcugaaggagcuuucuaaaaucgcugaaaugaccacacaaaugaagucccugcagcagcucgacauuagccaaaauuccguuucuuacgaugagaaaaagggggacugcagcuggaccaaaucccugcugucucuuaacaugagcuccaauauccucacagauaccauuuuucggugucugcccccucgcaucaaggugcuggaccuccauagcaacaagaucaaaucuauucccaagcaggucgugaaacuggaagcccuucaggagcugaauguugcuuucaacucccucacggaucugccuggaugcggcagcuuuucuucccugagcgugcuuaucauugaccacaacucugucagccaucccuccgccgauuucuuccagagcugucagaagaugagaucuaucaaagcgggggacaauccguuucaaugcacaugugagcucggagaguucgugaagaacauugaucaggucuccagcgaagugcuggaaggcuggccugacuccuauaagugcgacuaccccgagucuuaucgggggacccugcucaaagauuuucacaugagcgaacuguccugcaauaucacccuucugaucguuacaauuguggccaccaugcucguccuggcugugacaguuacgucucuguguagcuaccuugaccucccuugguaucugcgcauggugugccaguggacccagacaagacggcgcgccagaaacaucccccuggaggagcuccaacggaaucugcaguuccacgcuuuuauuuccuacucuggacaugauagcuucugggucaagaacgaacuucugcccaaucucgagaaagaaggcaugcagaucugucugcacgagcgcaacuuugugccuggcaaguccauuguggagaauaucauuaccugcauugaaaagagcuauaagucuaucuucguucuguccccgaacuuuguccagagcgaguggugucauuacgaacuuuacuucgcccaccacaaucuguuucaugaggggucuaacucccucauucugauccuccuggaacccauuccucaauauagcauccccucuuccuaccacaaacuuaaaagccugauggcgagacggacauaucucgaguggccuaaggagaaauccaagagaggacuguucugggccaaucugcgcgcugccaucaacauuaaacuuaccgaacaggcuaagaaauga

SEQ ID NO: 9564 - protein, 786 aa, Artificial Sequence [sequence omitted]

SEQ ID NO: 9565 - RNA, 2361 nt, Artificial Sequence
  TLR1__Homo_sapiens__AAH89403
augacuagcaucuuccauuuugccauuaucuucauguuaauacuucagaucagaauacaauuaucugaagaaagugaauuuuuaguugauaggucaaaaaacggucucauccacguuccuaaagaccuaucccagaaaacaacaaucuuaaauauaucgcaaaauuauauaucugagcuuuggacuucugacaucuuaucacugucaaaacugaggauuuugauaauuucucauaauagaauccaguaucuugauaucaguguuuucaaauucaaccaggaauuggaauacuuggauuugucccacaacaaguuggugaagauuucuugccacccuacugugaaccucaagcacuuggaccugucauuuaaugcauuugaugcccugccuauaugcaaagaguuuggcaauaugucucaacuaaaauuucugggguugagcaccacacacuuagaaaaaucuagugugcugccaauugcucauuugaauaucagcaaggucuugcuggucuuaggagagacuuauggggaaaaagaagacccugagggccuucaagacuuuaacacugagagucugcacauuguguuccccacaaacaaagaauuccauuuuauuuuggaugugucagucaagacuguagcaaaucuggaacuaucuaauaucaaaugugugcuagaagauaacaaauguucuuacuuccuaaguauucuggcgaaacuucaaacaaauccaaaguuaucaagucuuaccuuaaacaacauugaaacaacuuggaauucuuucauuaggauccuccagcugguuuggcauacaacuguaugguauuucucaauuucaaacgugaagcuacagggucagcuggacuucagagauuuugauuauucuggcacuuccuugaaggccuugucuauacaccaaguugucagcgauguguucgguuuuccgcaaaguuauaucuaugaaaucuuuucgaauaugaacaucaaaaauuucacagugucugguacacgcaugguccacaugcuuugcccauccaaaauuagcccguuccugaauuuggauuuuuccaauaaucucuuaacagacacgguuuuugaaaauugugggcaccuuacugaguuggagacacuuauuuuacaaaugaaucaauuaaaagaacuuucaaaaauagcugaaaugacuacacagaugaagucucugcaacaauuggauauuagccagaauucuguaagcuaugaugaaaagaaaggagacuguucuuggacuaaaaguuuauuaaguuuaaauaugucuucaaauauacuuacugacacuauuuucagauguuuaccucccaggaucaagguacuugaucuucacagcaauaaaauaaagagcauuccuaaacaagucguaaaacuggaagcuuugcaagaacucaauguugcuuucaauucuuuaacugaccuuccuggauguggcagcuuuagcagccuuucuguauugaucauugaucacaauucaguuucccacccaucagcugauuucuuccagagcugccagaagaugaggucaauaaaagcaggggacaauccauuccaauguaccugugagcuaggagaauuugucaaaaauauagaccaaguaucaagugaaguguuagagggcuggccugauucuuauaagugugacuacccggaaaguuauagaggaacccuacuaaaggacuuucacaugucugaauuauccugcaacauaacucugcugaucgucaccaucguugccaccaugcugguguuggcugugacugugaccucccucugcaucuacuuggaucugcccugguaucucaggauggugugccaguggacccagacccggcgcagggccaggaacauacccuuagaagaacuccaaagaaaucuccaguuucaugcauuuauuucauauagugggcacgauucuuucugggugaagaaugaauuauugccaaaccuagagaaagaagguaugcagauuugccuucaugagagaaacuuuguuccuggcaagagcauuguggaaaauaucaucaccugcauugagaagaguuacaaguccaucuuuguuuugucucccaacuuuguccagagugaauggugccauuaugaacucuacuuugcccaucacaaucucuuucaugaaggaucuaauagcuuaauccugaucuugcuggaacccauuccgcaguacuccauuccuagcaguuaucacaagcucaaaagucucauggccaggaggacuuauuuggaauggcccaaggaaaagagcaaacguggccuuuuuugggcuaacuuaagggcagccauuaauauuaagcugacagagcaagcaaagaaauag

SEQ ID NO: 9566 - RNA, 2361 nt, Artificial Sequence
  derived and/or modified sequence opt1 from TLR1__Homo_sapiens__AAH89403
augaccagcaucuuccacuucgccaucaucuucaugcugauccuccagauccgcauccagcuguccgaggagagcgaguuccugguggaccgguccaagaacggccucauccacguccccaaggaccugagccagaagaccacgauccugaacaucucccagaacuacaucagcgagcucuggaccuccgacauccugagccuguccaagcuccgcauccugaucaucagccacaaccggauccaguaccuggacaucuccguguucaaguucaaccaggagcucgaguaccuggaccugagccacaacaagcucgugaagaucuccugccacccgaccgucaaccugaagcaccuggaccucagcuucaacgccuucgacgcgcugcccaucugcaaggaguucgggaacaugucccagcugaaguuccucggccugagcaccacgcaccuggagaaguccagcgugcuccccaucgcccaccugaacaucuccaaggugcugcucguccugggggagaccuacggcgagaaggaggaccccgaggggcugcaggacuucaacaccgagagccuccacaucguguucccgaccaacaaggaguuccacuucauccuggacgugagcgucaagacgguggccaaccuggagcucuccaacaucaagugcgugcuggaggacaacaagugcagcuacuuccuguccauccucgccaagcugcagaccaaccccaagcugagcucccucacccugaacaacaucgagaccacguggaacagcuucauccgcauccugcagcucgucuggcacaccaccgugugguacuucuccaucagcaacgugaagcugcagggccagcuggacuuccgggacuucgacuacuccggcaccagccucaaggcccuguccauccaccaggucgugagcgacguguucggguucccccaguccuacaucuacgagaucuucagcaacaugaacaucaagaacuucacggucuccggcacccgcauggugcacaugcugugccccagcaagaucuccccguuccucaaccuggacuucagcaacaaccugcugaccgacaccguguucgagaacugcgggcaccucacggagcuggagacccugauccuccagaugaaccagcugaaggagcuguccaagaucgcggagaugaccacccagaugaagucccuccagcagcuggacaucagccagaacagcgucagcuacgacgagaagaagggcgacugcuccuggaccaagagccugcucucccugaacaugagcuccaacauccugaccgacaccaucuuccggugccucccgccccgcaucaaggugcuggaccugcacagcaacaagaucaaguccauccccaagcaggucgugaagcucgaggcccugcaggagcugaacguggccuucaacagccucaccgaccugcccgggugcggcuccuucagcucccugagcguccucaucaucgaccacaacuccgugagccaccccuccgccgacuucuuccagagcugccagaagaugcggagcaucaaggcgggcgacaaccccuuccagugcacgugcgagcugggggaguucgugaagaacaucgaccaggucuccagcgaggugcuggagggcuggcccgacuccuacaagugcgacuacccggagagcuaccgcgggacccuccugaaggacuuccacauguccgagcugagcugcaacaucacccuccugaucgugaccaucgucgccacgaugcuggugcucgccgugaccgucaccucccugugcaucuaccuggaccuccccugguaccugcggauggugugccaguggacccagacgcgccggcgcgcccggaacaucccccuggaggagcuccagcgcaaccugcaguuccacgccuucaucagcuacuccggccacgacagcuucugggugaagaacgagcugcuccccaaccuggagaaggagggcaugcagaucugccugcacgagcggaacuucgucccggggaaguccaucguggagaacaucaucacgugcaucgagaaguccuacaagagcaucuucgugcucagccccaacuucguccaguccgaguggugccacuacgagcuguacuucgcgcaccacaaccuguuccacgagggcagcaacucccucauccugauccugcucgagcccaucccccaguacagcaucccguccagcuaccacaagcucaagagccugauggcccgccggaccuaccuggaguggcccaaggagaaguccaagcgcgggcuguucugggccaaccugcgggccgccaucaacaucaagcucaccgagcaggcgaagaaguga

SEQ ID NO: 9567 - RNA, 2361 nt, Artificial Sequence
  derived and/or modified sequence opt2 from TLR1__Homo_sapiens__AAH89403
augaccuccaucuuccacuucgccaucaucuucaugcucauccuccagauccgcauccagcucuccgaggaguccgaguuccucgucgaccgcuccaagaacggccucauccacguccccaaggaccucucccagaagaccaccauccucaacaucucccagaacuacaucuccgagcucuggaccuccgacauccucucccucuccaagcuccgcauccucaucaucucccacaaccgcauccaguaccucgacaucuccgucuucaaguucaaccaggagcucgaguaccucgaccucucccacaacaagcucgucaagaucuccugccaccccaccgucaaccucaagcaccucgaccucuccuucaacgccuucgacgcccuccccaucugcaaggaguucggcaacaugucccagcucaaguuccucggccucuccaccacccaccucgagaaguccuccguccuccccaucgcccaccucaacaucuccaagguccuccucguccucggcgagaccuacggcgagaaggaggaccccgagggccuccaggacuucaacaccgagucccuccacaucgucuuccccaccaacaaggaguuccacuucauccucgacgucuccgucaagaccgucgccaaccucgagcucuccaacaucaagugcguccucgaggacaacaagugcuccuacuuccucuccauccucgccaagcuccagaccaaccccaagcucuccucccucacccucaacaacaucgagaccaccuggaacuccuucauccgcauccuccagcucgucuggcacaccaccgucugguacuucuccaucuccaacgucaagcuccagggccagcucgacuuccgcgacuucgacuacuccggcaccucccucaaggcccucuccauccaccaggucgucuccgacgucuucggcuucccccaguccuacaucuacgagaucuucuccaacaugaacaucaagaacuucaccgucuccggcacccgcaugguccacaugcucugccccuccaagaucucccccuuccucaaccucgacuucuccaacaaccuccucaccgacaccgucuucgagaacugcggccaccucaccgagcucgagacccucauccuccagaugaaccagcucaaggagcucuccaagaucgccgagaugaccacccagaugaagucccuccagcagcucgacaucucccagaacuccgucuccuacgacgagaagaagggcgacugcuccuggaccaagucccuccucucccucaacauguccuccaacauccucaccgacaccaucuuccgcugccuccccccccgcaucaagguccucgaccuccacuccaacaagaucaaguccauccccaagcaggucgucaagcucgaggcccuccaggagcucaacgucgccuucaacucccucaccgaccuccccggcugcggcuccuucuccucccucuccguccucaucaucgaccacaacuccgucucccaccccuccgccgacuucuuccaguccugccagaagaugcgcuccaucaaggccggcgacaaccccuuccagugcaccugcgagcucggcgaguucgucaagaacaucgaccaggucuccuccgagguccucgagggcuggcccgacuccuacaagugcgacuaccccgaguccuaccgcggcacccuccucaaggacuuccacauguccgagcucuccugcaacaucacccuccucaucgucaccaucgucgccaccaugcucguccucgccgucaccgucaccucccucugcaucuaccucgaccuccccugguaccuccgcauggucugccaguggacccagacccgccgccgcgcccgcaacaucccccucgaggagcuccagcgcaaccuccaguuccacgccuucaucuccuacuccggccacgacuccuucugggucaagaacgagcuccuccccaaccucgagaaggagggcaugcagaucugccuccacgagcgcaacuucguccccggcaaguccaucgucgagaacaucaucaccugcaucgagaaguccuacaaguccaucuucguccucucccccaacuucguccaguccgaguggugccacuacgagcucuacuucgcccaccacaaccucuuccacgagggcuccaacucccucauccucauccuccucgagcccaucccccaguacuccauccccuccuccuaccacaagcucaagucccucauggcccgccgcaccuaccucgaguggcccaaggagaaguccaagcgcggccucuucugggccaaccuccgcgccgccaucaacaucaagcucaccgagcaggccaagaaguga

SEQ ID NO: 9568 - RNA, 2361 nt, Artificial Sequence
  derived and/or modified sequence opt3 from TLR1__Homo_sapiens__AAH89403
augaccagcaucuuccacuuugccauuauauucaugcugauccuccagauuagaauccaacuuuccgaggaaucugaguuucugguggacaggucaaagaacggcuugauucauguccccaaagauuuaagucagaagacaacuauccugaauauaagccagaacuacaucuccgaacuauggacgucugacauucucucgcugucaaaacuucggauccugauuaucagccacaaucgcauacaguauuuggauauuaguguuuucaaguuuaaccaagagcucgaauaccuggaccugucccauaauaaacucgugaagaucucuugccacccuaccguaaacuuaaagcaucuggaucuuagcuucaaugcuuuugacgcauugccaauuuguaaagaguucgggaacaugucccagcugaaguuucuaggacucucaacaacucaccuggagaaaaguagcgugcuuccgaucgcccaccugaauaucucuaaggucuugcucgugcugggugaaaccuauggcgagaaagaagaucccgagggguuacaggacuucaacacagagucccugcauauuguuuuuccuaccaauaaggaguuccacuuuauacucgaugugucagucaagacuguggcgaaccuugaacugagcaauaucaaaugcguauuggaagacaacaaguguaguuacuuccuaucuauucuggcuaaacuccagacaaauccaaagcuguccagccuuacccugaacaacaucgagacgacuuggaauagcuucauacgaauuuugcaacucguuuggcauaccacagugugguauuuuucuaucuccaacgucaaacugcagggacaguuagauuuccgugacuuugauuacucaggcacuucacugaaggcccuaagcauccaccaggugguguccgacgucuucgguuuuccccaaucuuauauuuacgaaaucuucagcaauaugaacauuaaaaauuuuaccguuucagggacaagaauggugcacaugcucugcccuaguaagauauccccauuccugaaccuugacuuuagcaauaacuugcugaccgauacgguauucgagaauuguggacaucucacugagcuggaaacacuuauccugcagaugaaccaguugaaggagcucucuaaaauugcagaaaugaccacucaaaugaagucacugcagcaguuagacaucagucagaauagcguguccuacgaugagaaaaagggcgacugcucuuggacaaaaucgcugcuaagccucaacauguccucaaauauccugaccgauacgauuuuuaggugucuucccccucggauaaaggucuuggaccugcacaguaacaagaucaaaucuauuccaaagcaagugguuaaacucgaagcccugcaggaguuaaauguggcuuucaacagccugaccgaucuuccgggcugcggguccuuuaguagcuugucuguccucaucauugaccauaacuccgugagucaccccagcgcagauuucuuccagucuugucagaagaugcgcuccaucaaagccggagacaauccuuuucaaugcacaugugagcugggugaguucguaaagaacauagaucagguuucaagugaagugcuagaaggcuggccagacagcuauaagugcgacuaccccgagucguauagagggacucugcucaaagauuuucauauguccgaacugucuugcaauaucacccuuuugauugucacaaucguggcuacuaugcuggucuuagccgugaccguuacaagccucuguauuuaccuggaccuuccuugguaucugaggauggugugccaguggacccagacucggcgccgagcgagaaacaucccauuggaggagcuccaaaggaaucugcaguuccacgcauuuauaucauacaguggacacgauuccuucuggguaaagaacgaacuacugcccaaucucgagaaagaaggcaugcagauuugucugcaugagcggaacuuugucccggguaagucuaucguggagaauauuaucacgugcauagaaaaaucguauaaguccaucuucguucuuucaccuaacuuugugcagagcgaguggugucacuacgaauuguacuucgcccaucacaaucuguuucacgaggggaguaacucuuuaauucucauccugcuugaacccauuccacaauauuccaucccuagcucguaccauaagcugaaaucacuaauggcucgucgcacauaucucgaguggcccaaggagaaaucuaagagaggacuguucugggccaauuugagggcagcuauaaacauuaaacugaccgaacaggccaagaaauga

SEQ ID NO: 9569 - RNA, 2361 nt, Artificial Sequence
  derived and/or modified sequence opt4 from TLR1__Homo_sapiens__AAH89403
augaccagcaucuuccacuucgccaucaucuucaugcugauccugcagaucagaauccagcugagcgaggagagcgaguuccugguggacagaagcaagaacggccugauccacgugcccaaggaccugagccagaagaccaccauccugaacaucagccagaacuacaucagcgagcuguggaccagcgacauccugagccugagcaagcugagaauccugaucaucagccacaacagaauccaguaccuggacaucagcguguucaaguucaaccaggagcuggaguaccuggaccugagccacaacaagcuggugaagaucagcugccaccccaccgugaaccugaagcaccuggaccugagcuucaacgccuucgacgcccugcccaucugcaaggaguucggcaacaugagccagcugaaguuccugggccugagcaccacccaccuggagaagagcagcgugcugcccaucgcccaccugaacaucagcaaggugcugcuggugcugggcgagaccuacggcgagaaggaggaccccgagggccugcaggacuucaacaccgagagccugcacaucguguuccccaccaacaaggaguuccacuucauccuggacgugagcgugaagaccguggccaaccuggagcugagcaacaucaagugcgugcuggaggacaacaagugcagcuacuuccugagcauccuggccaagcugcagaccaaccccaagcugagcagccugacccugaacaacaucgagaccaccuggaacagcuucaucagaauccugcagcugguguggcacaccaccgugugguacuucagcaucagcaacgugaagcugcagggccagcuggacuucagagacuucgacuacagcggcaccagccugaaggcccugagcauccaccagguggugagcgacguguucggcuucccccagagcuacaucuacgagaucuucagcaacaugaacaucaagaacuucaccgugagcggcaccagaauggugcacaugcugugccccagcaagaucagccccuuccugaaccuggacuucagcaacaaccugcugaccgacaccguguucgagaacugcggccaccugaccgagcuggagacccugauccugcagaugaaccagcugaaggagcugagcaagaucgccgagaugaccacccagaugaagagccugcagcagcuggacaucagccagaacagcgugagcuacgacgagaagaagggcgacugcagcuggaccaagagccugcugagccugaacaugagcagcaacauccugaccgacaccaucuucagaugccugccccccagaaucaaggugcuggaccugcacagcaacaagaucaagagcauccccaagcagguggugaagcuggaggcccugcaggagcugaacguggccuucaacagccugaccgaccugcccggcugcggcagcuucagcagccugagcgugcugaucaucgaccacaacagcgugagccaccccagcgccgacuucuuccagagcugccagaagaugagaagcaucaaggccggcgacaaccccuuccagugcaccugcgagcugggcgaguucgugaagaacaucgaccaggugagcagcgaggugcuggagggcuggcccgacagcuacaagugcgacuaccccgagagcuacagaggcacccugcugaaggacuuccacaugagcgagcugagcugcaacaucacccugcugaucgugaccaucguggccaccaugcuggugcuggccgugaccgugaccagccugugcaucuaccuggaccugcccugguaccugagaauggugugccaguggacccagaccagaagaagagccagaaacaucccccuggaggagcugcagagaaaccugcaguuccacgccuucaucagcuacagcggccacgacagcuucugggugaagaacgagcugcugcccaaccuggagaaggagggcaugcagaucugccugcacgagagaaacuucgugcccggcaagagcaucguggagaacaucaucaccugcaucgagaagagcuacaagagcaucuucgugcugagccccaacuucgugcagagcgaguggugccacuacgagcuguacuucgcccaccacaaccuguuccacgagggcagcaacagccugauccugauccugcuggagcccaucccccaguacagcauccccagcagcuaccacaagcugaagagccugauggccagaagaaccuaccuggaguggcccaaggagaagagcaagagaggccuguucugggccaaccugagagccgccaucaacaucaagcugaccgagcaggccaagaaguga

SEQ ID NO: 9570 - RNA, 2361 nt, Artificial Sequence
  derived and/or modified sequence opt5 from TLR1__Homo_sapiens__AAH89403
augaccagcaucuuccacuuugccauuaucuucaugcugauucuccagauccggauucaacuguccgaggaaucugaguuucuuguggacagaagcaagaacggccugauccauguccccaaagaucucucccagaagacaacgauccugaauauuucucagaacuacaucagcgaacuuuggaccuccgacauucugucucucagcaaacugcgcauccugauuaucucccacaauagaauccaguaucucgauauuagcguuuucaaguuuaaccaagagcuggaauaccuugaccugucucauaauaaacucgugaagaucuccugccacccuacagugaaccugaagcaucuugaucugagcuucaaugcuuuugacgcccucccgauuuguaaagaguucgggaacaugucucagcugaaguuucugggacucuccaccacacaccuggagaaaagcucuguccuucccaucgcgcaccugaauauuuccaaggugcuccugguucuuggcgaaaccuauggggagaaagaagauccugagggacugcaggacuucaacacagagagccuccauaucguguuucccaccaauaaggaguuccacuuuauucuggaugucuccgugaagacgguugcuaaccuggaacucucuaauaucaaaugcgugcuggaagacaacaaguguagcuacuuccuuuccauccuggccaaacuccagaccaauccuaagcugagcucucuuacacugaacaacauugagaccacauggaacuccuucauccggauucuccaacuggucuggcauaccacggugugguauuuuagcaucucuaaugugaaacugcagggccagcucgauuuccgcgacuuugauuacagcgggacaucccugaaggcccuuucuauucaccaggucguuagcgacguguucggauuuccccaauccuauaucuacgaaaucuucagcaauaugaacauuaaaaauuuuaccgugucuggcacaagaaugguccacaugcugugcccuuccaagaucagcccguuccucaaccuggacuuuucuaauaaccugcuuaccgauaccguguucgagaauuguggccaucucacagagcuggaaacgcugauucuccagaugaaccagcugaaggagcuuuccaaaaucgcugaaaugaccacacaaaugaaaagccugcagcagcucgacauuucccaaaauucuguuagcuacgaugagaaaaagggggacugcuccuggaccaaaucucugcugagccuuaacauguccagcaauauccucacagauaccauuuuucggugucugcccccucgcaucaaggugcuggaccuccacucuaacaagaucaaauccauucccaagcaggucgugaaacuggaagcccuucaggagcugaauguugcuuucaacagccucacggaucugccuggaugcggcucuuuuuccagccugucugugcuuaucauugaccauaacagcgucucccaccccagcgccgauuucuuccagucuugucagaagaugagauccaucaaagcgggggacaauccguuucaaugcacaugugagcucggagaguucgugaagaacauugaucaggucagcuccgaagugcuggaaggcuggccugacucuuauaagugcgacuaccccgagagcuaucgggggacccugcucaaagauuuucauauguccgaacugucuugcaauaucacccuucugaucguuacaauuguggccaccaugcucguccuggcugugacaguuacgagccuguguaucuaccuugaccucccuugguaucugcgcauggugugccaguggacccagacaagacggcgcgccagaaacauuccccuggaggagcuccaacggaaucugcaguuccacgcuuuuaucuccuacucuggacacgauagcuucugggucaagaacgaacuucugcccaaucucgagaaagaaggcaugcagauuugucugcaugagcgcaacuuugugccuggcaaguccaucguggagaauaucauuaccugcaucgaaaagagcuauaagucuauuuucguucuguccccgaacuuuguccagagcgaguggugucacuacgaacuuuacuucgcccaucacaaucuguuucacgaggggucuaacucccucauccugauucuccuggaacccaucccucaauauagcauccccucuuccuaccauaaacuuaagagccugauggcgagacggacauaucucgaguggccuaaggagaaauccaagagaggacuguucugggccaaucugcgcgcugccauuaacaucaaacuuaccgaacaggcuaagaaauga

SEQ ID NO: 9571 - protein, 786 aa, Artificial Sequence [sequence omitted]

SEQ ID NO: 9572 - RNA, 2361 nt, Artificial Sequence
  TLR1__Homo_sapiens__CAG38593
augacuagcaucuuccauuuugccauuaucuucauguuaauacuucagaucagaauacaauuaucugaagaaagugaauuuuuaguugauaggucaaaaaacggucucauccacguuccuaaagaccuaucccagaaaacaacaaucuuaaauauaucgcaaaauuauauaucugagcuuuggacuucugacaucuuaucacugucaaaacugaggauuuugauaauuucucauaauagaauccaguaucuugauaucaguguuuucaaauucaaccaggaauuggaauacuuggauuugucccacaacaaguuggugaagauuucuugccacccuacugugaaccucaagcacuuggaccugucauuuaaugcauuugaugcccugccuauaugcaaagaguuuggcaauaugucucaacuaaaauuucugggguugagcaccacacacuuagaaaaaucuagugugcugccaauugcucauuugaauaucagcaaggucuugcuggucuuaggagagacuuauggggaaaaagaagacccugggggccuucaagacuuuaacacugagagucugcacauuguguuccccacaaacaaagaauuccauuuuauuuuggaugugucagucaagacuguagcaaaucuggaacuaucuaauaucaaaugugugcuagaagauagcaaauguucuuacuuccuaaguauucuggcgaaacuucaaacaaauccaaaguuaucaagucuuaccuuaaacaacauugaaacaacuuggaauucuuucauuaggauccuccagcugguuuggcauacaacuguaugguauuccucaauuucaaacgugaagcuacagggucagcuggacuucagagauuuugauuauucuggcacuuccuugaaggccuugucuauacaccaaguugucagcgauguguucgguuuuccgcaaaguuauaucuaugaaaucuuuucgaauaugaacaucaaaaauuucacagugucugguacacgcaugguccacaugcuuugcccauccaaaauuagcccguuccugcauuuggauuuuuccaauaaucucuuaacagacacgguuuuugaaaauugugggcaccuuacugaguuggagacacuuauuuuacaaaugaaucaauuaaaagaacuuucaaaaauagcugaaaugacuacacagaugaagucucugcaacaauuggauauuagccagaauucuguaagcuaugaugaaaagaaaggagacuguucuuggacuaaaaguuuauuaaguuuaaauaugucuucaaauauacuuacugacacuauuuucagauguuuaccucccaggaucaagguacuugaucuucacagcaauaaaauaaagagcauuccuaaacaagucguaaaacuggaagcuuugcaagaacucaauguugcuuucaauucuuuaacugaccuuccuggauguggcagcuuuagcagccuuucuguauugaucauugaucacaauucaguuucccacccaucagcugauuucuuccagagcugccagaagaugaggucaauaaaagcaggggacaauccauuccaauguaccugugagcuaggagaauuugucaaaaauauagaccaaguaucaagugaaguguuagagggcuggccugauucuuauaagugugacuacccggaaaguuauagaggaacccuacuaaaggacuuucacaugucugaauuauccugcaacauaacucugcugaucgucaccaucguugccaccaugcugguguuggcugugacugugaccucccucugcaucuacuuggaucugcccugguaucucaggauggugugccaguggacccagacccggcgcagggccaggaacauacccuuagaagaacuccaaagaaaucuccaguuucaugcauuuauuucauauagugggcacgauucuuucuggaugaagaaugaauuauugccaaaccuagagaaagaagguaugcagauuugccuucaugagagaaacuuuguuccuggcaagagcauuguggaaaauaucaucaccugcauugagaagaguuacaaguccaucuuuguuuugucucccaacuuuguccagagugaauggugccauuaugaacucuacuuugcccaucacaaucucuuucaugaaggaucuaauagcuuaauccugaucuugcuggaacccauuccgcaguacuccauuccuagcaguuaucacaagcucaaaagucucauggccaggaggacuuauuuggaauggcccaaggaaaagagcaaacguggccuuuuuugggcuaacuuaagggcagccauuaauauuaagcugacagagcaagcaaagaaauag

SEQ ID NO: 9573 - RNA, 2361 nt, Artificial Sequence
  derived and/or modified sequence opt1 from TLR1__Homo_sapiens__CAG38593
augaccagcaucuuccacuucgccaucaucuucaugcugauccuccagauccgcauccagcuguccgaggagagcgaguuccugguggaccgguccaagaacggccucauccacguccccaaggaccugagccagaagaccacgauccugaacaucucccagaacuacaucagcgagcucuggaccuccgacauccugagccuguccaagcuccgcauccugaucaucagccacaaccggauccaguaccuggacaucuccguguucaaguucaaccaggagcucgaguaccuggaccugagccacaacaagcucgugaagaucuccugccacccgaccgucaaccugaagcaccuggaccucagcuucaacgccuucgacgcgcugcccaucugcaaggaguucgggaacaugucccagcugaaguuccucggccugagcaccacgcaccuggagaaguccagcgugcuccccaucgcccaccugaacaucuccaaggugcugcucguccugggggagaccuacggcgagaaggaggaccccgggggccugcaggacuucaacaccgagagccuccacaucguguucccgaccaacaaggaguuccacuucauccuggacgugagcgucaagacgguggccaaccuggagcucuccaacaucaagugcgugcuggaggacagcaagugcuccuacuuccugagcauccucgccaagcugcagaccaaccccaagcuguccagccucacccugaacaacaucgagaccacguggaacuccuucauccgcauccugcagcucgucuggcacaccaccgugugguacagcuccaucagcaacgugaagcugcagggccagcuggacuuccgggacuucgacuacuccgggaccagccucaaggcccuguccauccaccaggucgugagcgacguguucggcuucccccaguccuacaucuacgagaucuucagcaacaugaacaucaagaacuucacggucuccgggacccgcauggugcacaugcugugccccagcaagaucuccccguuccuccaccuggacuucagcaacaaccugcugaccgacaccguguucgagaacugcggccaccucacggagcuggagacccugauccuccagaugaaccagcugaaggagcugagcaagaucgcggagaugaccacccagaugaagucccuccagcagcuggacaucagccagaacuccgucagcuacgacgagaagaagggggacugcuccuggaccaagagccugcucucccugaacaugagcuccaacauccugaccgacaccaucuuccggugccucccgccccgcaucaaggugcuggaccugcacagcaacaagaucaaguccauccccaagcaggucgugaagcucgaggcccugcaggagcugaacguggccuucaacagccucaccgaccugcccggcugcggcuccuucagcucccugagcguccucaucaucgaccacaacuccgugagccaccccagcgccgacuucuuccaguccugccagaagaugcggagcaucaaggcgggggacaaccccuuccagugcacgugcgagcugggcgaguucgugaagaacaucgaccaggucuccagcgaggugcuggagggguggcccgacuccuacaagugcgacuacccggagagcuaccgcggcacccuccugaaggacuuccacauguccgagcugagcugcaacaucacccuccugaucgugaccaucgucgccacgaugcuggugcucgccgugaccgucaccucccugugcaucuaccuggaccuccccugguaccugcggauggugugccaguggacccagacgcgccggcgcgcccggaacaucccccuggaggagcuccagcgcaaccugcaguuccacgccuucaucagcuacuccggccacgacagcuucuggaugaagaacgagcugcuccccaaccuggagaaggaggggaugcagaucugccugcacgagcggaacuucgugccgggcaaguccaucgucgagaacaucaucacgugcaucgagaaguccuacaagagcaucuucgugcucagccccaacuucgugcaguccgaguggugccacuacgagcuguacuucgcgcaccacaaccuguuccacgaggggagcaacucccucauccugauccugcucgagcccaucccccaguacagcaucccgagcuccuaccacaagcucaagagccugauggcccgccggaccuaccuggaguggcccaaggagaaguccaagcgcggccuguucugggccaaccugcgggccgccaucaacaucaagcucaccgagcaggcgaagaaguga

SEQ ID NO: 9574 - RNA, 2361 nt, Artificial Sequence
  derived and/or modified sequence opt2 from TLR1__Homo_sapiens__CAG38593
augaccuccaucuuccacuucgccaucaucuucaugcucauccuccagauccgcauccagcucuccgaggaguccgaguuccucgucgaccgcuccaagaacggccucauccacguccccaaggaccucucccagaagaccaccauccucaacaucucccagaacuacaucuccgagcucuggaccuccgacauccucucccucuccaagcuccgcauccucaucaucucccacaaccgcauccaguaccucgacaucuccgucuucaaguucaaccaggagcucgaguaccucgaccucucccacaacaagcucgucaagaucuccugccaccccaccgucaaccucaagcaccucgaccucuccuucaacgccuucgacgcccuccccaucugcaaggaguucggcaacaugucccagcucaaguuccucggccucuccaccacccaccucgagaaguccuccguccuccccaucgcccaccucaacaucuccaagguccuccucguccucggcgagaccuacggcgagaaggaggaccccggcggccuccaggacuucaacaccgagucccuccacaucgucuuccccaccaacaaggaguuccacuucauccucgacgucuccgucaagaccgucgccaaccucgagcucuccaacaucaagugcguccucgaggacuccaagugcuccuacuuccucuccauccucgccaagcuccagaccaaccccaagcucuccucccucacccucaacaacaucgagaccaccuggaacuccuucauccgcauccuccagcucgucuggcacaccaccgucugguacuccuccaucuccaacgucaagcuccagggccagcucgacuuccgcgacuucgacuacuccggcaccucccucaaggcccucuccauccaccaggucgucuccgacgucuucggcuucccccaguccuacaucuacgagaucuucuccaacaugaacaucaagaacuucaccgucuccggcacccgcaugguccacaugcucugccccuccaagaucucccccuuccuccaccucgacuucuccaacaaccuccucaccgacaccgucuucgagaacugcggccaccucaccgagcucgagacccucauccuccagaugaaccagcucaaggagcucuccaagaucgccgagaugaccacccagaugaagucccuccagcagcucgacaucucccagaacuccgucuccuacgacgagaagaagggcgacugcuccuggaccaagucccuccucucccucaacauguccuccaacauccucaccgacaccaucuuccgcugccuccccccccgcaucaagguccucgaccuccacuccaacaagaucaaguccauccccaagcaggucgucaagcucgaggcccuccaggagcucaacgucgccuucaacucccucaccgaccuccccggcugcggcuccuucuccucccucuccguccucaucaucgaccacaacuccgucucccaccccuccgccgacuucuuccaguccugccagaagaugcgcuccaucaaggccggcgacaaccccuuccagugcaccugcgagcucggcgaguucgucaagaacaucgaccaggucuccuccgagguccucgagggcuggcccgacuccuacaagugcgacuaccccgaguccuaccgcggcacccuccucaaggacuuccacauguccgagcucuccugcaacaucacccuccucaucgucaccaucgucgccaccaugcucguccucgccgucaccgucaccucccucugcaucuaccucgaccuccccugguaccuccgcauggucugccaguggacccagacccgccgccgcgcccgcaacaucccccucgaggagcuccagcgcaaccuccaguuccacgccuucaucuccuacuccggccacgacuccuucuggaugaagaacgagcuccuccccaaccucgagaaggagggcaugcagaucugccuccacgagcgcaacuucguccccggcaaguccaucgucgagaacaucaucaccugcaucgagaaguccuacaaguccaucuucguccucucccccaacuucguccaguccgaguggugccacuacgagcucuacuucgcccaccacaaccucuuccacgagggcuccaacucccucauccucauccuccucgagcccaucccccaguacuccauccccuccuccuaccacaagcucaagucccucauggcccgccgcaccuaccucgaguggcccaaggagaaguccaagcgcggccucuucugggccaaccuccgcgccgccaucaacaucaagcucaccgagcaggccaagaaguga

SEQ ID NO: 9575 - RNA, 2361 nt, Artificial Sequence
  derived and/or modified sequence opt3 from TLR1__Homo_sapiens__CAG38593
augaccagcaucuuccacuuugccauuauauucaugcugauccuccagauuagaauccaacuuuccgaggaaucugaguuucugguggacaggucaaagaacggcuugauucauguccccaaagauuuaagucagaagacaacuauccugaauauaagccagaacuacaucuccgaacuauggacgucugacauucucucgcugucaaaacuucggauccugauuaucagccacaaucgcauacaguauuuggauauuaguguuuucaaguuuaaccaagagcucgaauaccuggaccugucccauaauaaacucgugaagaucucuugccacccuaccguaaacuuaaagcaucuggaucuuagcuucaaugcuuuugacgcauugccaauuuguaaagaguucgggaacaugucccagcugaaguuucuaggacucucaacaacucaccuggagaaaaguagcgugcuuccgaucgcccaccugaauaucucuaaggucuugcucgugcugggugaaaccuauggcgagaaagaagaucccgggggauuacaggacuucaacacagagucccugcauauuguuuuuccuaccaauaaggaguuccacuuuauacucgaugugucagucaagacuguggcgaaccuugaacugagcaauaucaaaugcguauuggaggacaguaaguguucuuacuuccuauccauucuggcuaaacuccagacaaacccaaagcugagcucgcuuacccugaauaacaucgaaacgacuuggaacucuuucauacgaauuuugcaacucguuuggcauaccacagugugguauuccucaaucaguaaugucaaacugcagggccaguuagauuuucgugacuucgauuacagcgguacuucccugaaggcccuaucuauccaccagguggugagcgacgucuuuggguucccccaaucauauauuuacgagaucuuuaguaacaugaauauuaaaaacuucaccguuuccggaacaagaauggugcacaugcucugcccuagcaagauaucuccauuucugcaucuugacuucucaaauaacuugcugaccgauacgguauuugaaaauuguggccaccucacugagcuggagacacuuauccugcagaugaaccaguugaaggaacucaguaaaauugcagagaugaccacucaaaugaaaagccugcagcaguuagacaucucccagaauagcgugucguacgaugaaaagaagggcgacugcagcuggacaaaaucccugcuaucacucaacaugaguucuaauauccugaccgauacgauuuucaggugucuucccccucggauaaaggucuuggaccugcauagcaacaagaucaaauccauuccaaagcaagugguuaaacucgaggcccugcaggaauuaaauguggcuuuuaacucacugaccgaucuuccggggugcggaucuuucucuuccuugaguguccucaucauugaccacaauagcgugucucaucccuccgcagacuuuuuccagucaugucagaagaugcgcaguaucaaagccggugauaacccuuuccaaugcacaugugagcugggcgaguuuguaaagaacauagaucagguuagcucggaagugcuagagggguggccagacuccuauaagugcgacuaccccgaaucuuauagaggaacucugcucaaagauuuccacaugagcgagcugucaugcaauaucacccuuuugauugucacaaucguggcuacuaugcuggucuuagccgugaccguuacaagucucuguauuuaccuggaccuuccuugguaucugaggauggugugccaguggacccagacucggcgccgagcgagaaacaucccauuggaggaacuccaaaggaaucugcaguuucacgcauucauauccuacucuggccaugauagcuuuuggaugaagaacgagcuacugcccaaucucgaaaaagaggguaugcagauuugucugcacgaacggaacuucguaccggggaaguccaucgucgagaauauuaucacgugcauagagaaaucauauaagagcaucuuugugcuuaguccuaacuucguucagucugaauggugucauuacgaguuguacuuugcccaccacaaucuguuccaugaaggauccaacagcuuaauucucauccugcuugagcccauuccacaauauucgaucccuucaucuuaccacaagcugaaaagucuaauggcucgucgcacauaucucgaauggcccaaggagaaauccaagagaggccuguuuugggccaauuugagggcagcuauaaacauuaaacugaccgagcaggccaagaaauga

SEQ ID NO: 9576 - RNA, 2361 nt, Artificial Sequence
  derived and/or modified sequence opt4 from TLR1__Homo_sapiens__CAG38593
augaccagcaucuuccacuucgccaucaucuucaugcugauccugcagaucagaauccagcugagcgaggagagcgaguuccugguggacagaagcaagaacggccugauccacgugcccaaggaccugagccagaagaccaccauccugaacaucagccagaacuacaucagcgagcuguggaccagcgacauccugagccugagcaagcugagaauccugaucaucagccacaacagaauccaguaccuggacaucagcguguucaaguucaaccaggagcuggaguaccuggaccugagccacaacaagcuggugaagaucagcugccaccccaccgugaaccugaagcaccuggaccugagcuucaacgccuucgacgcccugcccaucugcaaggaguucggcaacaugagccagcugaaguuccugggccugagcaccacccaccuggagaagagcagcgugcugcccaucgcccaccugaacaucagcaaggugcugcuggugcugggcgagaccuacggcgagaaggaggaccccggcggccugcaggacuucaacaccgagagccugcacaucguguuccccaccaacaaggaguuccacuucauccuggacgugagcgugaagaccguggccaaccuggagcugagcaacaucaagugcgugcuggaggacagcaagugcagcuacuuccugagcauccuggccaagcugcagaccaaccccaagcugagcagccugacccugaacaacaucgagaccaccuggaacagcuucaucagaauccugcagcugguguggcacaccaccgugugguacagcagcaucagcaacgugaagcugcagggccagcuggacuucagagacuucgacuacagcggcaccagccugaaggcccugagcauccaccagguggugagcgacguguucggcuucccccagagcuacaucuacgagaucuucagcaacaugaacaucaagaacuucaccgugagcggcaccagaauggugcacaugcugugccccagcaagaucagccccuuccugcaccuggacuucagcaacaaccugcugaccgacaccguguucgagaacugcggccaccugaccgagcuggagacccugauccugcagaugaaccagcugaaggagcugagcaagaucgccgagaugaccacccagaugaagagccugcagcagcuggacaucagccagaacagcgugagcuacgacgagaagaagggcgacugcagcuggaccaagagccugcugagccugaacaugagcagcaacauccugaccgacaccaucuucagaugccugccccccagaaucaaggugcuggaccugcacagcaacaagaucaagagcauccccaagcagguggugaagcuggaggcccugcaggagcugaacguggccuucaacagccugaccgaccugcccggcugcggcagcuucagcagccugagcgugcugaucaucgaccacaacagcgugagccaccccagcgccgacuucuuccagagcugccagaagaugagaagcaucaaggccggcgacaaccccuuccagugcaccugcgagcugggcgaguucgugaagaacaucgaccaggugagcagcgaggugcuggagggcuggcccgacagcuacaagugcgacuaccccgagagcuacagaggcacccugcugaaggacuuccacaugagcgagcugagcugcaacaucacccugcugaucgugaccaucguggccaccaugcuggugcuggccgugaccgugaccagccugugcaucuaccuggaccugcccugguaccugagaauggugugccaguggacccagaccagaagaagagccagaaacaucccccuggaggagcugcagagaaaccugcaguuccacgccuucaucagcuacagcggccacgacagcuucuggaugaagaacgagcugcugcccaaccuggagaaggagggcaugcagaucugccugcacgagagaaacuucgugcccggcaagagcaucguggagaacaucaucaccugcaucgagaagagcuacaagagcaucuucgugcugagccccaacuucgugcagagcgaguggugccacuacgagcuguacuucgcccaccacaaccuguuccacgagggcagcaacagccugauccugauccugcuggagcccaucccccaguacagcauccccagcagcuaccacaagcugaagagccugauggccagaagaaccuaccuggaguggcccaaggagaagagcaagagaggccuguucugggccaaccugagagccgccaucaacaucaagcugaccgagcaggccaagaaguga

SEQ ID NO: 9577 - RNA, 2361 nt, Artificial Sequence
  derived and/or modified sequence opt5 from TLR1__Homo_sapiens__CAG38593
augaccagcaucuuccacuuugccauuaucuucaugcugauucuccagauccggauucaacuguccgaggaaucugaguuucuuguggacagaagcaagaacggccugauccauguccccaaagaucucucccagaagacaacgauccugaauauuucucagaacuacaucagcgaacuuuggaccuccgacauucugucucucagcaaacugcgcauccugauuaucucccacaauagaauccaguaucucgauauuagcguuuucaaguuuaaccaagagcuggaauaccuugaccugucucauaauaaacucgugaagaucuccugccacccuacagugaaccugaagcaucuugaucugagcuucaaugcuuuugacgcccucccgauuuguaaagaguucgggaacaugucucagcugaaguuucugggacucuccaccacacaccuggagaaaagcucuguccuucccaucgcgcaccugaauauuuccaaggugcuccugguucuuggcgaaaccuauggggagaaagaagauccuggaggccugcaggacuucaacacagagagccuccauaucguguuucccaccaauaaggaguuccacuuuauucuggaugucuccgugaagacgguugcuaaccuggaacucucuaauaucaaaugcgugcuggaggacagcaaguguuccuacuuccuuagcauccuggccaaacuccagaccaacccuaagcugucuucccuuacacugaauaacauugaaaccacauggaacagcuucauccggauucuccaacuggucuggcauaccacggugugguauucuagcaucuccaaugugaaacugcaggggcagcucgauuuucgcgacuucgauuacucuggaacaagccugaaggcccuuuccauucaccaggucguuagcgacguguuuggcuucccccaaucuuauaucuacgagaucuuuuccaacaugaauauuaaaaacuucaccgugagcggcacaagaaugguccacaugcugugcccuucuaagaucuccccguuucuccaucuggacuucagcaauaaccugcuuaccgauaccguguuugaaaauugugggcaccucacagagcuggagacgcugauucuccagaugaaccagcugaaggaacuuuccaaaaucgcugagaugaccacacaaaugaagucucugcagcagcucgacauuagccaaaauuccguuucuuacgaugaaaagaagggagacugcagcuggaccaaaucccugcugagccuuaacaugucuuccaauauccucacagauaccauuuuccggugucugcccccucgcaucaaggugcuggaccuccauagcaacaagaucaaaucuauucccaagcaggucgugaaacuggaggcccuucaggaacugaauguugcuuuuaacucccucacggaucugccuggcugcgggagcuucucuagccuguccgugcuuaucauugaccacaauagcgucucucaucccuccgccgacuuuuuccagagcugucagaagaugagauccaucaaagcgggagauaacccguuccaaugcacaugugagcucggcgaguuugugaagaacauugaucaggucucuagcgaagugcuggagggguggccugacuccuauaagugcgacuaccccgaaucuuaucggggaacccugcucaaagauuuccacaugagcgagcuguccugcaauaucacccuucugaucguuacaauuguggccaccaugcucguccuggcugugacaguuacgucucuguguaucuaccuugaccucccuugguaucugcgcauggugugccaguggacccagacaagacggcgcgccagaaacauuccccuggaggaacuccaacggaaucugcaguuucacgcuuucaucagcuacuccggccaugauagcuuuuggaugaagaacgagcuucugcccaaucucgaaaaagagggcaugcagauuugucugcacgaacgcaacuucgucccugggaagucuaucguggagaauaucauuaccugcaucgagaaauccuauaagagcauuuuugugcugucuccgaacuucguucaguccgaauggugucauuacgagcuuuacuuugcccaccacaaucuguuccaugaaggaagcaacucucucauccugauucuccuggagcccaucccucaauauuccauccccagcuccuaccacaaacuuaaaagccugauggcgagacggacauaucucgaauggccuaaggagaaaucuaagagaggccuguuuugggccaaucugcgcgcugccauuaacaucaaacuuaccgagcaggcuaagaaauga

SEQ ID NO: 9578 - protein, 784 aa, Artificial Sequence
  TLR2__Homo_sapiens__O60603
MPHTLWMVWVLGVIISLSKEESSNQASLSCDRNGICKGSSGSLNSIPSGLTEAVKSLDLSNNRITYISNSDLQRCVNLQALVLTSNGINTIEEDSFSSLGSLEHLDLSYNYLSNLSSSWFKPLSSLTFLNLLGNPYKTLGETSLFSHLTKLQILRVGNMDTFTKIQRKDFAGLTFLEELEIDASDLQSYEPKSLKSIQNVSHLILHMKQHILLLEIFVDVTSSVECLELRDTDLDTFHFSELSTGETNSLIKKFTFRNVKITDESLFQVMKLLNQISGLLELEFDDCTLNGVGNFRASDNDRVIDPGKVETLTIRRLHIPRFYLFYDLSTLYSLTERVKRITVENSKVFLVPCLLSQHLKSLEYLDLSENLMVEEYLKNSACEDAWPSLQTLILRQNHLASLEKTGETLLTLKNLTNIDISKNSFHSMPETCQWPEKMKYLNLSSTRIHSVTGCIPKTLEILDVSNNNLNLFSLNLPQLKELYISRNKLMTLPDASLLPMLLVLKISRNAITTFSKEQLDSFHTLKTLEAGGNNFICSCEFLSFTQEQQALAKVLIDWPANYLCDSPSHVRGQQVQDVRLSVSECHRTALVSGMCCALFLLILLTGVLCHRFHGLWYMKMMWAWLQAKRKPRKAPSRNICYDAFVSYSERDAYWVENLMVQELENFNPPFKLCLHKRDFIPGKWIIDNIIDSIEKSHKTVFVLSENFVKSEWCKYELDFSHFRLFDENNDAAILILLEPIEKKAIPQRFCKLRKIMNTKTYLEWPMDEAQREGFWVNLRAAIKS

SEQ ID NO: 9579 - RNA, 2355 nt, Artificial Sequence
  TLR2__Homo_sapiens__AAC34377
augccacauacuuuguggaugguguggguccugggggucaucaucagccucuccaaggaagaauccuccaaucaggcuucucugucuugugaccgcaaugguaucugcaagggcagcucaggaucuuuaaacuccauucccucagggcucacagaagcuguaaaaagccuugaccuguccaacaacaggaucaccuacauuagcaacagugaccuacagaggugugugaaccuccaggcucuggugcugacauccaauggaauuaacacaauagaggaagauucuuuuucuucccugggcagucuugaacauuuagacuuauccuauaauuacuuaucuaauuuaucgucuuccugguucaagccccuuucuucuuuaacauucuuaaacuuacugggaaauccuuacaaaacccuaggggaaacaucucuuuuuucucaucucacaaaauugcaaauccugagagugggaaauauggacaccuucacuaagauucaaagaaaagauuuugcuggacuuaccuuccuugaggaacuugagauugaugcuucagaucuacagagcuaugagccaaaaaguuugaagucaauucagaauguaagucaucugauccuucauaugaagcagcauauuuuacugcuggagauuuuuguagauguuacaaguuccguggaauguuuggaacugcgagauacugauuuggacacuuuccauuuuucagaacuauccacuggugaaacaaauucauugauuaaaaaguuuacauuuagaaaugugaaaaucaccgaugaaaguuuguuucagguuaugaaacuuuugaaucagauuucuggauuguuagaauuagaguuugaugacuguacccuuaauggaguugguaauuuuagagcaucugauaaugacagaguuauagauccagguaaaguggaaacguuaacaauccggaggcugcauauuccaagguuuuacuuauuuuaugaucugagcacuuuauauucacuuacagaaagaguuaaaagaaucacaguagaaaacaguaaaguuuuucugguuccuuguuuacuuucacaacauuuaaaaucauuagaauacuuggaucucagugaaaauuugaugguugaagaauacuugaaaaauucagccugugaggaugccuggcccucucuacaaacuuuaauuuuaaggcaaaaucauuuggcaucauuggaaaaaaccggagagacuuugcucacucugaaaaacuugacuaacauugauaucaguaagaauaguuuucauucuaugccugaaacuugucaguggccagaaaagaugaaauauuugaacuuauccagcacacgaauacacaguguaacaggcugcauucccaagacacuggaaauuuuagauguuagcaacaacaaucucaauuuauuuucuuugaauuugccgcaacucaaagaacuuuauauuuccagaaauaaguugaugacucuaccagaugccucccucuuacccauguuacuaguauugaaaaucaguaggaaugcaauaacuacguuuucuaaggagcaacuugacucauuucacacacugaagacuuuggaagcugguggcaauaacuucauuugcuccugugaauuccucuccuucacucaggagcagcaagcacuggccaaagucuugauugauuggccagcaaauuaccugugugacucuccaucccaugugcguggccagcagguucaggauguccgccucucggugucggaaugucacaggacagcacuggugucuggcaugugcugugcucuguuccugcugauccugcucacggggguccugugccaccguuuccauggccugugguauaugaaaaugaugugggccuggcuccaggccaaaaggaagcccaggaaagcucccagcaggaacaucugcuaugaugcauuuguuucuuacagugagcgggaugccuacuggguggagaaccuuaugguccaggagcuggagaacuucaauccccccuucaaguugugucuucauaagcgggacuucauuccuggcaaguggaucauugacaauaucauugacuccauugaaaagagccacaaaacugucuuugugcuuucugaaaacuuugugaagagugaguggugcaaguaugaacuggacuucucccauuuccgucuuuuugaugagaacaaugaugcugccauucucauucuucuggagcccauugagaaaaaagccauuccccagcgcuucugcaagcugcggaagauaaugaacaccaagaccuaccuggaguggcccauggacgaggcucagcgggaaggauuuuggguaaaucugagagcugcgauaaaguccuag

SEQ ID NO: 9580 - RNA, 2355 nt, Artificial Sequence
  derived and/or modified sequence opt1 from TLR2__Homo_sapiens__AAC34377
augccccacacccuguggaugguguggguccucggcgugaucaucagccuguccaaggaggagagcuccaaccaggccagccuguccugcgaccgcaacgggaucugcaagggcagcuccgggagccucaacuccaucccgagcggccugaccgaggccgugaagucccuggaccucagcaacaaccggaucacguacaucuccaacagcgaccugcagcgcugcgucaaccugcaggcgcucgugcugaccuccaacgggaucaacaccaucgaggaggacagcuucuccagccugggcucccucgagcaccuggaccugagcuacaacuaccucagcaaccuguccagcuccugguucaagccccugagcucccucaccuuccugaaccugcucggcaaccccuacaagacgcugggggagaccagccuguucucccaccucaccaagcugcagauccugcgggugggcaacauggacaccuucacgaagauccagcgcaaggacuucgccgggcucaccuuccuggaggagcuggagaucgacgccagcgaccuccaguccuacgagcccaagagccugaaguccauccagaacgucagccaccugauccuccacaugaagcagcacauccugcugcucgagaucuucguggacgugaccuccagcgucgagugccuggagcugcgggacaccgaccucgacacguuccacuucuccgagcugagcaccggcgagaccaacucccugaucaagaaguucaccuuccgcaacgugaagaucacggacgagagccucuuccaggugaugaagcugcugaaccagaucuccgggcuccuggagcuggaguucgacgacugcacccucaacggcgucggcaacuuccgggccagcgacaacgaccgcgugaucgacccggggaagguggagacccugaccauccggcgccugcacaucccccgguucuaccuguucuacgaccucagcacgcuguacucccugaccgagcgcgucaagcggaucaccguggagaacagcaagguguuccucguccccugccugcugucccagcaccucaagagccuggaguaccuggaccucuccgagaaccugaugguggaggaguaccugaagaacagcgccugcgaggacgcguggcccucccuccagacccugauccugcgccagaaccaccucgccagccuggagaagacgggcgagacccugcucacccugaagaaccugaccaacaucgacaucuccaagaacagcuuccacuccaugccggagacgugccaguggcccgagaagaugaaguaccucaaccugagcuccacccggauccacagcgugaccgggugcauccccaagacccuggagauccucgacgucuccaacaacaaccugaaccuguucagccucaaccugccccagcugaaggagcucuacaucucccgcaacaagcugaugacgcugccggacgccagccuccugcccaugcugcucgugcugaagaucagccggaacgccaucaccaccuucuccaaggagcagcuggacagcuuccacacccucaagacgcuggaggcgggcggcaacaacuucaucugcuccugcgaguuccugagcuucacccaggagcagcaggcccucgccaaggugcugaucgacuggcccgccaacuaccugugcgacucccccagccacguccgcgggcagcagguccaggacgugcggcucuccgugagcgagugccaccgcaccgcccugguguccggcaugugcugcgcgcuguuccuccugauccugcucaccgggguccugugccaccgguuccacggccugugguacaugaagaugaugugggccuggcuccaggccaagcgcaagccgcgcaaggcccccagccggaacaucugcuacgacgccuucguguccuacagcgagcgcgacgcguacuggguggagaaccugaugguccaggagcuggagaacuucaacccgcccuucaagcucugccugcacaagcgggacuucauccccgggaaguggaucaucgacaacaucaucgacuccaucgagaagucccacaagaccguguucgugcugagcgagaacuucgucaagagcgaguggugcaaguacgagcucgacuucucccacuuccgccuguucgacgagaacaacgacgccgccauccugauccuccuggagcccaucgagaagaaggccaucccccagcgguucugcaagcugcgcaagaucaugaacacgaagaccuaccucgaguggcccauggacgaggcccagcgggagggcuucugggugaaccugcgcgcggccaucaagagcuga

SEQ ID NO: 9581 - RNA, 2355 nt, Artificial Sequence
  derived and/or modified sequence opt2 from TLR2__Homo_sapiens__AAC34377
augccccacacccucuggauggucuggguccucggcgucaucaucucccucuccaaggaggaguccuccaaccaggccucccucuccugcgaccgcaacggcaucugcaagggcuccuccggcucccucaacuccauccccuccggccucaccgaggccgucaagucccucgaccucuccaacaaccgcaucaccuacaucuccaacuccgaccuccagcgcugcgucaaccuccaggcccucguccucaccuccaacggcaucaacaccaucgaggaggacuccuucuccucccucggcucccucgagcaccucgaccucuccuacaacuaccucuccaaccucuccuccuccugguucaagccccucuccucccucaccuuccucaaccuccucggcaaccccuacaagacccucggcgagaccucccucuucucccaccucaccaagcuccagauccuccgcgucggcaacauggacaccuucaccaagauccagcgcaaggacuucgccggccucaccuuccucgaggagcucgagaucgacgccuccgaccuccaguccuacgagcccaagucccucaaguccauccagaacgucucccaccucauccuccacaugaagcagcacauccuccuccucgagaucuucgucgacgucaccuccuccgucgagugccucgagcuccgcgacaccgaccucgacaccuuccacuucuccgagcucuccaccggcgagaccaacucccucaucaagaaguucaccuuccgcaacgucaagaucaccgacgagucccucuuccaggucaugaagcuccucaaccagaucuccggccuccucgagcucgaguucgacgacugcacccucaacggcgucggcaacuuccgcgccuccgacaacgaccgcgucaucgaccccggcaaggucgagacccucaccauccgccgccuccacaucccccgcuucuaccucuucuacgaccucuccacccucuacucccucaccgagcgcgucaagcgcaucaccgucgagaacuccaaggucuuccucguccccugccuccucucccagcaccucaagucccucgaguaccucgaccucuccgagaaccucauggucgaggaguaccucaagaacuccgccugcgaggacgccuggcccucccuccagacccucauccuccgccagaaccaccucgccucccucgagaagaccggcgagacccuccucacccucaagaaccucaccaacaucgacaucuccaagaacuccuuccacuccaugcccgagaccugccaguggcccgagaagaugaaguaccucaaccucuccuccacccgcauccacuccgucaccggcugcauccccaagacccucgagauccucgacgucuccaacaacaaccucaaccucuucucccucaaccucccccagcucaaggagcucuacaucucccgcaacaagcucaugacccuccccgacgccucccuccuccccaugcuccucguccucaagaucucccgcaacgccaucaccaccuucuccaaggagcagcucgacuccuuccacacccucaagacccucgaggccggcggcaacaacuucaucugcuccugcgaguuccucuccuucacccaggagcagcaggcccucgccaagguccucaucgacuggcccgccaacuaccucugcgacucccccucccacguccgcggccagcagguccaggacguccgccucuccgucuccgagugccaccgcaccgcccucgucuccggcaugugcugcgcccucuuccuccucauccuccucaccggcguccucugccaccgcuuccacggccucugguacaugaagaugaugugggccuggcuccaggccaagcgcaagccccgcaaggcccccucccgcaacaucugcuacgacgccuucgucuccuacuccgagcgcgacgccuacugggucgagaaccucaugguccaggagcucgagaacuucaacccccccuucaagcucugccuccacaagcgcgacuucauccccggcaaguggaucaucgacaacaucaucgacuccaucgagaagucccacaagaccgucuucguccucuccgagaacuucgucaaguccgaguggugcaaguacgagcucgacuucucccacuuccgccucuucgacgagaacaacgacgccgccauccucauccuccucgagcccaucgagaagaaggccaucccccagcgcuucugcaagcuccgcaagaucaugaacaccaagaccuaccucgaguggcccauggacgaggcccagcgcgagggcuucugggucaaccuccgcgccgccaucaaguccuga

SEQ ID NO: 9582 - RNA, 2355 nt, Artificial Sequence
  derived and/or modified sequence opt3 from TLR2__Homo_sapiens__AAC34377
augccccacacccuguggaugguguggguccucggcguuaucauuagccuuuccaaggaggaaucuucaaaccaggccagucugagcugcgacagaaaugggauauguaaaggauccucugguucguugaacucaaucccuagcggcuuaacagaggcugugaagagucuggaucuauccaauaacaggauuacuuacaucucuaauagcgaccuccaacggugcguaaaccugcaggcacuugugcugacguccaaugggauuaacaccaucgaagaggauucauucaguagcuugggaucucucgaacaucuggaccuguccuauaauuaccucucaaacuuaagcaguucuugguuuaaaccacuguccagccuuacauucuugaaucugcuaggcaacccguauaagacucucggugagaccucgcuguuuucucaccuuacaaaacugcagauauugcgcgucgggaauauggauaccuucacuaagauccagcgaaaggacuuugccggacucacauuccuggaggaauuagagauugaugcguccgaccugcaaucauacgaacccaaaagucucaagagcauccagaacgugucccaucuuauucugcacaugaaacagcauaucuugcuacuggagauauuuguugaugugaccucuagcgucgagugucucgaacugcgugacacggaucuugacacuuuccacuuuucagagcugaguaccggcgaaacaaauuccuugauuaagaaauucacuuuuagaaacgugaagaucaccgaugagagccucuuccagguaaugaagcuguuaaaccaaauuucuggccugcuagaacucgaguuugacgacugcacacugaaugggguuggaaacuucagggcuucagauaaugaccgggugaucgauccugguaaagucgagacccuuacgauccgcagauugcacauuccaagguucuaucuguuuuacgaccucaguacucuguauagccuuacagaacgggugaagcgcauaaccguggagaacuccaaagucuuccugguucccuguuugcucucucagcaucugaagucguuagaauaccuggaucuaagcgagaaucucaugguggaagaguaccugaaaaacuccgccugcgaggacgcauggccuucacuucagacuuugauccugcgacagaaucaccucgccagucuggaaaagacaggcgagaccuuacugacgcuuaaaaacuugaccaauauugauaucucuaagaacagcuuucauuccaugccagaaacaugucaauggcccgagaagaugaaauaucucaaucugucaagcacuagaauacacucuguaaccgggugcauuccuaagacacuagaaauccuggacguguccaacaauaaccucaaucuguucagucuuaacuugccacagcugaaagaguuauacaucagcaggaacaagcucaugacucugccggaugcuucucuucugcccauguugcucguccugaaaauuucccggaaugcaaucaccacauuuucaaaggagcagcuagacaguuuccacacccugaagacucucgaagccggaggcaacaauuuuauuuguagcugcgaguuccugucguuuacgcaagaacagcaggcucuugccaaaguguugauagauuggccugcgaacuaucugugugacuccccaucucauguucguggucagcaagugcaggacguccgcuuaagcgugucagagugccacagaacagcacucguaagugggaugugcugugcccuguuccuucugauccuacucaccggaguucugugccauagguuucacggcuugugguacaugaagaugaugugggcuuggcugcaggccaaacggaagccccgaaaagcaccuucccgcaauauuuguuaugaugcuuucgugucuuacagcgagagagacgccuauugggucgaaaacuuaauggugcaggagcucgaaaauuuuaacccacccuucaagcugugccuucauaagagggauuucaucccgggcaaauggaucauugacaauauaaucgauuccauugagaagucacacaaaacugucuuugugcugagcgaaaacuucguuaagagugagugguguaaauacgaguuggacuuuucucacuuccggcucuuugaugaaaauaacgacgcggccauccugauucuacuggagccuaucgaaaagaaggcaauaccccaacgcuucugcaaacuuagaaagaucaugaauaccaaaacauaccucgaguggccaauggaugaagcucagagggagggguuuugggugaaccugcgugccgcuauuaaguccuga

SEQ ID NO: 9583 - RNA, 2355 nt, Artificial Sequence
  derived and/or modified sequence opt4 from TLR2__Homo_sapiens__AAC34377
augccccacacccuguggauggugugggugcugggcgugaucaucagccugagcaaggaggagagcagcaaccaggccagccugagcugcgacagaaacggcaucugcaagggcagcagcggcagccugaacagcauccccagcggccugaccgaggccgugaagagccuggaccugagcaacaacagaaucaccuacaucagcaacagcgaccugcagagaugcgugaaccugcaggcccuggugcugaccagcaacggcaucaacaccaucgaggaggacagcuucagcagccugggcagccuggagcaccuggaccugagcuacaacuaccugagcaaccugagcagcagcugguucaagccccugagcagccugaccuuccugaaccugcugggcaaccccuacaagacccugggcgagaccagccuguucagccaccugaccaagcugcagauccugagagugggcaacauggacaccuucaccaagauccagagaaaggacuucgccggccugaccuuccuggaggagcuggagaucgacgccagcgaccugcagagcuacgagcccaagagccugaagagcauccagaacgugagccaccugauccugcacaugaagcagcacauccugcugcuggagaucuucguggacgugaccagcagcguggagugccuggagcugagagacaccgaccuggacaccuuccacuucagcgagcugagcaccggcgagaccaacagccugaucaagaaguucaccuucagaaacgugaagaucaccgacgagagccuguuccaggugaugaagcugcugaaccagaucagcggccugcuggagcuggaguucgacgacugcacccugaacggcgugggcaacuucagagccagcgacaacgacagagugaucgaccccggcaagguggagacccugaccaucagaagacugcacauccccagauucuaccuguucuacgaccugagcacccuguacagccugaccgagagagugaagagaaucaccguggagaacagcaagguguuccuggugcccugccugcugagccagcaccugaagagccuggaguaccuggaccugagcgagaaccugaugguggaggaguaccugaagaacagcgccugcgaggacgccuggcccagccugcagacccugauccugagacagaaccaccuggccagccuggagaagaccggcgagacccugcugacccugaagaaccugaccaacaucgacaucagcaagaacagcuuccacagcaugcccgagaccugccaguggcccgagaagaugaaguaccugaaccugagcagcaccagaauccacagcgugaccggcugcauccccaagacccuggagauccuggacgugagcaacaacaaccugaaccuguucagccugaaccugccccagcugaaggagcuguacaucagcagaaacaagcugaugacccugcccgacgccagccugcugcccaugcugcuggugcugaagaucagcagaaacgccaucaccaccuucagcaaggagcagcuggacagcuuccacacccugaagacccuggaggccggcggcaacaacuucaucugcagcugcgaguuccugagcuucacccaggagcagcaggcccuggccaaggugcugaucgacuggcccgccaacuaccugugcgacagccccagccacgugagaggccagcaggugcaggacgugagacugagcgugagcgagugccacagaaccgcccuggugagcggcaugugcugcgcccuguuccugcugauccugcugaccggcgugcugugccacagauuccacggccugugguacaugaagaugaugugggccuggcugcaggccaagagaaagcccagaaaggcccccagcagaaacaucugcuacgacgccuucgugagcuacagcgagagagacgccuacuggguggagaaccugauggugcaggagcuggagaacuucaacccccccuucaagcugugccugcacaagagagacuucauccccggcaaguggaucaucgacaacaucaucgacagcaucgagaagagccacaagaccguguucgugcugagcgagaacuucgugaagagcgaguggugcaaguacgagcuggacuucagccacuucagacuguucgacgagaacaacgacgccgccauccugauccugcuggagcccaucgagaagaaggccaucccccagagauucugcaagcugagaaagaucaugaacaccaagaccuaccuggaguggcccauggacgaggcccagagagagggcuucugggugaaccugagagccgccaucaagagcuga

SEQ ID NO: 9584 - RNA, 2355 nt, Artificial Sequence
  derived and/or modified sequence opt5 from TLR2__Homo_sapiens__AAC34377
augccccacacccuguggaugguguggguccucggcguuaucauuagccuguccaaggaggaaucuagcaaccaggccucccuuucuugcgacagaaaugggaucuguaaaggaagcuccggcucucugaacagcauuccuuccgggcucacagaggcugucaagagccuggaucuuucuaauaaccggaucacguacauuuccaauagcgaccugcaacgcugcgugaaccuccaggcccuggugcugaccucuaauggaaucaacacaaucgaagaggauuccuucagcucucucggcucccuggaacaucuugaccugagcuauaauuaccucuccaaccugucuagcuccugguuuaaaccgcuuagcucucugaccuuccucaaucugcuggggaaccccuauaagacacucggagagaccucccuguuuagccaccuuacaaaacugcagauucucagagugggcaauauggauaccuucacgaagauccagcggaaggacuuugcgggccugaccuuccuugaggaacuggagauugaugcuucugaccuccaaagcuacgaaccuaaaucccugaagucuauccagaacguuagccaucugauucuccacaugaaacagcauauccugcuucuggagauuuuuguggaugucacauccagcguggagugucucgaacugcgcgacaccgaucuugacacauuccacuuuucugagcuguccaccggggaaacgaauagccucaucaagaaauucacauuuagaaacguuaagaucaccgaugagucucuguuccaggugaugaagcugcucaaccaaauuuccggacugcuugaacuggaguuugacgacugcacacucaauggcgucgggaacuuccgggccagcgauaaugaccgcgugaucgaucccggaaaaguggagacccugaccauuagacggcugcacaucccucgcuucuaucucuuuuacgaccuuuccacacuguauucucugacggaaagagucaagcggauuaccguugagaacagcaaaguguuccucgugcccugucugcuuucccagcaucugaagucucucgaauaccuggaucugagcgagaaucuuauggucgaagaguaccucaaaaacuccgccugcgaggacgcuuggccuagccugcagacacugauccuccgccagaaucaccuggccucucuugaaaagaccggcgagacacugcucacccugaaaaaccugacgaauaucgauauuuccaagaacagcuuucauucuaugccggaaacaugucaauggcccgagaagaugaaauaucuuaaucucuccagcaccagaauccacucugugaccgggugcauuccuaagacacuggaaauccuggacguuagcaacaauaaccucaaucuguucucccuuaaccugccccagcucaaagagcuguacauuagccggaacaagcugaugacccuuccugaugcuucucuccugcccaugcugcucgugcugaaaaucucccgcaaugccaucacaacguuuagcaaggagcagcuugacuccuuccacacccugaagacacucgaagcgggaggcaacaauuuuauuuguucuugcgaguuccugagcuuuacccaagaacagcaggcccuggcuaaaguccuuaucgauuggccggccaacuaucugugugacuccccuucucaugugagaggccagcaaguucaggacgugcggcucagcgucuccgagugccacagaacagcucuggugucugggaugugcugugcccucuuccugcuuauucugcucaccggaguccugugccaucgcuuucacggccugugguacaugaagaugaugugggcguggcuucaggccaaacggaagcccagaaaagcuccuagccgcaauaucuguuaugaugccuucguguccuacagcgagcgggacgcuuauuggguugaaaaccugauggugcaggagcucgaaaauuuuaacccucccuucaagcugugccuccauaagagagauuucauucccgggaaauggaucauugacaauaucaucgauucuauugagaagucccacaaaacggucuuugugcugagcgaaaacuucguuaagucugagugguguaaauacgagcuugacuuuucccacuuccgccuguuugaugaaaauaacgacgccgccauccucauucugcuggagccgaucgaaaagaaggcuauuccccaacgguucugcaaacuuagaaagaucaugaauaccaaaacauaccuggaguggccuauggaugaagcgcagcgcgagggauuuugggugaaccuccgggccgcuaucaagagcuga

SEQ ID NO: 9585 - protein, 904 aa, Artificial Sequence
  TLR3__Homo_sapiens__O15455
MRQTLPCIYFWGGLLPFGMLCASSTTKCTVSHEVADCSHLKLTQVPDDLPTNITVLNLTHNQLRRLPAANFTRYSQLTSLDVGFNTISKLEPELCQKLPMLKVLNLQHNELSQLSDKTFAFCTNLTELHLMSNSIQKIKNNPFVKQKNLITLDLSHNGLSSTKLGTQVQLENLQELLLSNNKIQALKSEELDIFANSSLKKLELSSNQIKEFSPGCFHAIGRLFGLFLNNVQLGPSLTEKLCLELANTSIRNLSLSNSQLSTTSNTTFLGLKWTNLTMLDLSYNNLNVVGNDSFAWLPQLEYFFLEYNNIQHLFSHSLHGLFNVRYLNLKRSFTKQSISLASLPKIDDFSFQWLKCLEHLNMEDNDIPGIKSNMFTGLINLKYLSLSNSFTSLRTLTNETFVSLAHSPLHILNLTKNKISKIESDAFSWLGHLEVLDLGLNEIGQELTGQEWRGLENIFEIYLSYNKYLQLTRNSFALVPSLQRLMLRRVALKNVDSSPSPFQPLRNLTILDLSNNNIANINDDMLEGLEKLEILDLQHNNLARLWKHANPGGPIYFLKGLSHLHILNLESNGFDEIPVEVFKDLFELKIIDLGLNNLNTLPASVFNNQVSLKSLNLQKNLITSVEKKVFGPAFRNLTELDMRFNPFDCTCESIAWFVNWINETHTNIPELSSHYLCNTPPHYHGFPVRLFDTSSCKDSAPFELFFMINTSILLIFIFIVLLIHFEGWRISFYWNVSVHRVLGFKEIDRQTEQFEYAAYIIHAYKDKDWVWEHFSSMEKEDQSLKFCLEERDFEAGVFELEAIVNSIKRSRKIIFVITHHLLKDPLCKRFKVHHAVQQAIEQNLDSIILVFLEEIPDYKLNHALCLRRGMFKSHCILNWPVQKERIGAFRHKLQVALGSKNSVH

SEQ ID NO: 9586 - RNA, 2715 nt, Artificial Sequence
  TLR3__Homo_sapiens__AAC34134
augagacagacuuugccuuguaucuacuuuugggggggccuuuugcccuuugggaugcugugugcauccuccaccaccaagugcacuguuagccaugaaguugcugacugcagccaccugaaguugacucagguacccgaugaucuacccacaaacauaacaguguugaaccuuacccauaaucaacucagaagauuaccagccgccaacuucacaagguauagccagcuaacuagcuuggauguaggauuuaacaccaucucaaaacuggagccagaauugugccagaaacuucccauguuaaaaguuuugaaccuccagcacaaugagcuaucucaacuuucugauaaaaccuuugccuucugcacgaauuugacugaacuccaucucauguccaacucaauccagaaaauuaaaaauaaucccuuugucaagcagaagaauuuaaucacauuagaucugucucauaauggcuugucaucuacaaaauuaggaacucagguucagcuggaaaaucuccaagagcuucuauuaucaaacaauaaaauucaagcgcuaaaaagugaagaacuggauaucuuugccaauucaucuuuaaaaaaauuagaguugucaucgaaucaaauuaaagaguuuucuccaggguguuuucacgcaauuggaagauuauuuggccucuuucugaacaauguccagcugggucccagccuuacagagaagcuauguuuggaauuagcaaacacaagcauucggaaucugucucugaguaacagccagcuguccaccaccagcaauacaacuuucuugggacuaaaguggacaaaucucacuaugcucgaucuuuccuacaacaacuuaaaugugguugguaacgauuccuuugcuuggcuuccacaacuagaauauuucuuccuagaguauaauaauauacagcauuuguuuucucacucuuugcacgggcuuuucaaugugagguaccugaauuugaaacggucuuuuacuaaacaaaguauuucccuugccucacuccccaagauugaugauuuuucuuuucaguggcuaaaauguuuggagcaccuuaacauggaagauaaugauauuccaggcauaaaaagcaauauguucacaggauugauaaaccugaaauacuuaagucuauccaacuccuuuacaaguuugcgaacuuugacaaaugaaacauuuguaucacuugcucauucucccuuacacauacucaaccuaaccaagaauaaaaucucaaaaauagagagugaugcuuucucuugguugggccaccuagaaguacuugaccugggccuuaaugaaauugggcaagaacucacaggccaggaauggagaggucuagaaaauauuuucgaaaucuaucuuuccuacaacaaguaccugcagcugacuaggaacuccuuugccuuggucccaagccuucaacgacugaugcuccgaaggguggcccuuaaaaauguggauagcucuccuucaccauuccagccucuucguaacuugaccauucuggaucuaagcaacaacaacauagccaacauaaaugaugacauguuggagggucuugagaaacuagaaauucucgauuugcagcauaacaacuuagcacggcucuggaaacacgcaaacccugguggucccauuuauuuccuaaagggucugucucaccuccacauccuuaacuuggaguccaacggcuuugacgagaucccaguugaggucuucaaggauuuauuugaacuaaagaucaucgauuuaggauugaauaauuuaaacacacuuccagcaucugucuuuaauaaucaggugucucuaaagucauugaaccuucagaagaaucucauaacauccguugagaagaagguuuucgggccagcuuucaggaaccugacugaguuagauaugcgcuuuaaucccuuugauugcacgugugaaaguauugccugguuuguuaauuggauuaacgagacccauaccaacaucccugagcugucaagccacuaccuuugcaacacuccaccucacuaucauggguucccagugagacuuuuugauacaucaucuugcaaagacagugcccccuuugaacucuuuuucaugaucaauaccaguauccuguugauuuuuaucuuuauuguacuucucauccacuuugagggcuggaggauaucuuuuuauuggaauguuucaguacaucgaguucuugguuucaaagaaauagacagacagacagaacaguuugaauaugcagcauauauaauucaugccuauaaagauaaggauugggucugggaacauuucucuucaauggaaaaggaagaccaaucucucaaauuuugucuggaagaaagggacuuugaggcggguguuuuugaacuagaagcaauuguuaacagcaucaaaagaagcagaaaaauuauuuuuguuauaacacaccaucuauuaaaagacccauuaugcaaaagauucaagguacaucaugcaguucaacaagcuauugaacaaaaucuggauuccauuauauugguuuuccuugaggagauuccagauuauaaacugaaccaugcacucuguuugcgaagaggaauguuuaaaucucacugcaucuugaacuggccaguucagaaagaacggauaggugccuuucgucauaaauugcaaguagcacuuggauccaaaaacucuguacauuaa

SEQ ID NO: 9587 - RNA, 2715 nt, Artificial Sequence
  derived and/or modified sequence opt1 from TLR3__Homo_sapiens__AAC34134
augcgccagacccugcccugcaucuacuucuggggcgggcuccugccguucggcaugcugugcgccagcuccaccacgaagugcaccgugagccacgaggucgccgacugcucccaccucaagcugacccaggugcccgacgaccugcccaccaacaucacggugcucaaccugacccacaaccagcugcggcgccuccccgcggccaacuucacccgguacagccagcugaccucccuggacgucggguucaacacgaucagcaagcucgagccggagcugugccagaagcugcccaugcucaaggugcugaaccugcagcacaacgagcucucccagcugagcgacaagaccuucgccuucugcaccaaccugaccgagcuccaccugauguccaacagcauccagaagaucaagaacaaccccuucgugaagcagaagaaccugaucacgcucgaccugucccacaacggccugagcuccaccaagcucgggacccagguccagcuggagaaccugcaggagcuccugcugagcaacaacaagauccaggcccucaaguccgaggagcuggacaucuucgccaacagcucccugaagaagcucgagcugagcuccaaccagaucaaggaguucagccccggcugcuuccacgcgaucggccgccuguucggccucuuccugaacaacgugcagcuggggccgagccucaccgagaagcugugccuggagcucgccaacacguccauccggaaccugagccuguccaacagccagcucuccaccaccagcaacaccacguuccuggggcugaaguggaccaaccugaccaugcucgaccuguccuacaacaaccugaacguggucggcaacgacagcuucgccuggcucccccagcuggaguacuucuuccuggaguacaacaacauccagcaccucuucucccacagccugcacgggcuguucaacgugcgcuaccucaaccugaagcgguccuucaccaagcagagcaucucccuggccagccuccccaagaucgacgacuucuccuuccaguggcugaagugccuggagcaccucaacauggaggacaacgacauccccggcaucaagagcaacauguucacgggccugaucaaccugaaguaccucucccugagcaacuccuucaccagccugcgcacccucaccaacgagacguucgugagccuggcgcacuccccgcugcacauccucaaccugaccaagaacaagaucagcaagaucgaguccgacgccuucagcuggcuggggcaccucgagguccuggaccugggccucaacgagaucgggcaggagcugaccggccaggaguggcggggccuggagaacaucuucgagaucuaccucuccuacaacaaguaccugcagcugacccgcaacagcuucgcccucgugcccucccugcagcggcugaugcuccgccggguggcccugaagaacgucgacagcucccccagccccuuccagccgcugcgcaaccucacgauccuggaccuguccaacaacaacaucgccaacaucaacgacgacaugcucgaggggcuggagaagcuggagauccucgaccugcagcacaacaaccuggcgcggcucuggaagcacgccaaccccggcgggcccaucuacuuccugaagggccugagccaccuccacauccugaaccuggaguccaacggguucgacgagauccccguggagguguucaaggaccucuucgagcugaagaucaucgaccugggccucaacaaccugaacacccugccggccagcgucuucaacaaccaggugucccucaagagccugaaccugcagaagaaccucaucaccuccguggagaagaaggucuucggccccgccuuccgcaaccugaccgagcuggacaugcgguucaaccccuucgacugcacgugcgagagcaucgccugguucgugaacuggaucaacgagacccacaccaacauccccgagcucagcucccacuaccugugcaacaccccgccccacuaccacggguuccccgugcgccuguucgacaccagcuccugcaaggacagcgcgcccuucgagcuguucuucaugaucaacacguccauccugcugaucuucaucuucaucguccuccugauccacuucgagggcuggcggaucagcuucuacuggaacguguccguccaccgcgugcugggguucaaggagaucgaccggcagaccgagcaguucgaguacgccgccuacaucauccacgccuacaaggacaaggacugggugugggagcacuucagcuccauggagaaggaggaccagagccucaaguucugccuggaggagcgcgacuucgaggccggcgucuucgagcuggaggcgaucgugaacuccaucaagcgcagccggaagaucaucuucgugaucacccaccaccuccugaaggacccgcugugcaagcgcuucaagguccaccacgccgugcagcaggccaucgagcagaaccucgacuccaucauccugguguuccuggaggagauccccgacuacaagcucaaccacgcccugugccugcggcgcgggauguucaagagccacugcauccucaacuggcccguccagaaggagcggaucggcgccuuccgccacaagcuccagguggcgcugggcuccaagaacagcgugcacuga

SEQ ID NO: 9588 - RNA, 2715 nt, Artificial Sequence
  derived and/or modified sequence opt2 from TLR3__Homo_sapiens__AAC34134
augcgccagacccuccccugcaucuacuucuggggcggccuccuccccuucggcaugcucugcgccuccuccaccaccaagugcaccgucucccacgaggucgccgacugcucccaccucaagcucacccagguccccgacgaccuccccaccaacaucaccguccucaaccucacccacaaccagcuccgccgccuccccgccgccaacuucacccgcuacucccagcucaccucccucgacgucggcuucaacaccaucuccaagcucgagcccgagcucugccagaagcuccccaugcucaagguccucaaccuccagcacaacgagcucucccagcucuccgacaagaccuucgccuucugcaccaaccucaccgagcuccaccucauguccaacuccauccagaagaucaagaacaaccccuucgucaagcagaagaaccucaucacccucgaccucucccacaacggccucuccuccaccaagcucggcacccagguccagcucgagaaccuccaggagcuccuccucuccaacaacaagauccaggcccucaaguccgaggagcucgacaucuucgccaacuccucccucaagaagcucgagcucuccuccaaccagaucaaggaguucucccccggcugcuuccacgccaucggccgccucuucggccucuuccucaacaacguccagcucggccccucccucaccgagaagcucugccucgagcucgccaacaccuccauccgcaaccucucccucuccaacucccagcucuccaccaccuccaacaccaccuuccucggccucaaguggaccaaccucaccaugcucgaccucuccuacaacaaccucaacgucgucggcaacgacuccuucgccuggcucccccagcucgaguacuucuuccucgaguacaacaacauccagcaccucuucucccacucccuccacggccucuucaacguccgcuaccucaaccucaagcgcuccuucaccaagcaguccaucucccucgccucccuccccaagaucgacgacuucuccuuccaguggcucaagugccucgagcaccucaacauggaggacaacgacauccccggcaucaaguccaacauguucaccggccucaucaaccucaaguaccucucccucuccaacuccuucaccucccuccgcacccucaccaacgagaccuucgucucccucgcccacuccccccuccacauccucaaccucaccaagaacaagaucuccaagaucgaguccgacgccuucuccuggcucggccaccucgagguccucgaccucggccucaacgagaucggccaggagcucaccggccaggaguggcgcggccucgagaacaucuucgagaucuaccucuccuacaacaaguaccuccagcucacccgcaacuccuucgcccucguccccucccuccagcgccucaugcuccgccgcgucgcccucaagaacgucgacuccucccccucccccuuccagccccuccgcaaccucaccauccucgaccucuccaacaacaacaucgccaacaucaacgacgacaugcucgagggccucgagaagcucgagauccucgaccuccagcacaacaaccucgcccgccucuggaagcacgccaaccccggcggccccaucuacuuccucaagggccucucccaccuccacauccucaaccucgaguccaacggcuucgacgagauccccgucgaggucuucaaggaccucuucgagcucaagaucaucgaccucggccucaacaaccucaacacccuccccgccuccgucuucaacaaccaggucucccucaagucccucaaccuccagaagaaccucaucaccuccgucgagaagaaggucuucggccccgccuuccgcaaccucaccgagcucgacaugcgcuucaaccccuucgacugcaccugcgaguccaucgccugguucgucaacuggaucaacgagacccacaccaacauccccgagcucuccucccacuaccucugcaacacccccccccacuaccacggcuuccccguccgccucuucgacaccuccuccugcaaggacuccgcccccuucgagcucuucuucaugaucaacaccuccauccuccucaucuucaucuucaucguccuccucauccacuucgagggcuggcgcaucuccuucuacuggaacgucuccguccaccgcguccucggcuucaaggagaucgaccgccagaccgagcaguucgaguacgccgccuacaucauccacgccuacaaggacaaggacugggucugggagcacuucuccuccauggagaaggaggaccagucccucaaguucugccucgaggagcgcgacuucgaggccggcgucuucgagcucgaggccaucgucaacuccaucaagcgcucccgcaagaucaucuucgucaucacccaccaccuccucaaggacccccucugcaagcgcuucaagguccaccacgccguccagcaggccaucgagcagaaccucgacuccaucauccucgucuuccucgaggagauccccgacuacaagcucaaccacgcccucugccuccgccgcggcauguucaagucccacugcauccucaacuggcccguccagaaggagcgcaucggcgccuuccgccacaagcuccaggucgcccucggcuccaagaacuccguccacuga

SEQ ID NO: 9589 - RNA, 2715 nt, Artificial Sequence
  derived and/or modified sequence opt3 from TLR3__Homo_sapiens__AAC34134
augagacagacccugcccugcaucuacuucuggggcgggcuccuuccuuuuggaaugcugugugccagcuccacaacuaagugcacggugucucacgaggucgcugacuguucacauuugaaauuaacccaaguuccagaugaccugccgacaaacauuacugugcuaaaucucacccacaaccagcugaggcggcuucccgcagccaauuucacacgcuauagucagcugaccagcuuggauguagguuuuaacacuauauccaagcucgaaccugagcugugccagaaacugccaaugcucaagguguuaaaucugcaacauaacgaacuuucucaguugucggacaaaacauucgcguuuuguaccaaucugacggagcuacaccucaugucaaacagcauccagaagauuaagaauaaccccuucgucaaacagaagaaucugaucacucuugaucugagucauaacggcuuguccucuaccaaacucgggacacaagugcagcuggaaaauuuacaggagcugcuccuuagcaacaauaagauucaggcucugaaauccgaggaauuggacaucuuugccaacucaagucuaaagaagcuggagcucagcucuaaccaaauaaaagaguucuccccuggaugcuuucacgcaaucggccgacuguucggucuuuuucugaauaacguucaguuggggccaucacucacugaaaagcuguguuuagagcuggccaauaccagcauucguaaccuaagucucucuaauucccagcugagcacaaccucgaacacgacuuuccuuggauugaaauggacaaaucugaccaugcucgaucugucuuacaacaaucuuaacguggucggcaaugacuccuuugcuuggcugccccaauuggaauauuucuuccucgaguacaacaauauccagcaccuguuuucacauaguuuacacggccuguucaacgugagauaucuaaaucucaagaggagcuuuacuaaacaguccauuucucuggcaagccuuccuaagaucgaugacuucucauuucagugguugaaaugccuggaacaucucaacauggaggauaacgacauaccagggauuaagaguaauauguucacaggacugaucaacuuaaaguaccugucccuuagcaauucuuuuaccucauugcggacgcucaccaacgaaacauucguaagucuggcccacagcccgcuacacauucugaaucucacuaaaaacaagaucuccaaaaucgagucugaugcuuuuucguggcugggucaucuugagguuuuggaccugggcuuaaaugaaauugggcaagagcucaccggacaggaauggcgcggccuggagaacauauucgaaaucuaucuuagcuacaauaaguaccugcaguugacaagaaacuccuuugcccucgugcccucacugcagaggcuaaugcugcggcgcgucgcgcucaaaaauguggacaguucuccuagcccauuccaaccccugcgaaaccuuacuauuuuggaucuguccaauaacaauaucgcaaacauaaacgacgauauguuagagggucucgagaagcuggaaauucuugaccugcagcacaauaaccuagccagacucuggaagcaugcuaauccugggggaccaaucuauuuucugaaaggcuugucacaucugcacaucuuaaaccucgagagcaauggcuucgaugaaauucccguggaggucuucaaggaccuguuugaacuuaaaaucauugaucugggguugaacaaucucaacacccugccggccucuguuuucaauaaccaggugucccuaaagagucugaaucuucagaaaaaccucauaacaagcguagagaagaagguguuuggaccugcauucaggaaucugaccgaguuggacaugcgguuuaaccccuucgauuguacuugcgaaucuaucgcuugguuugucaauuggauuaacgagacgcacacaaacaucccagaacuguccucacacuacuuauguaauaccccuccccauuaucacgguuucccagugcgucucuuugacaccaguagcugcaaagauucggcccccuucgagcuguuuuucaugaucaacacuuccauucuucugauauuuaucuucauuguuuugcucauccauuucgagggcuggcgcauuucuuuuuacuggaaugugagcguccacagagugcugggguucaaggaaaucgacaggcaaacagagcaguuugaauaugcggccuacauaauccacgcauauaaagacaaggauuggguaugggagcauuucucaaguauggaaaaagaggaccagucccuaaaguuuugccuggaggaacgggauuucgaggcuggaguuuuugaacuugaggccauugugaacucuaucaagcgaagccgcaaaauuaucuucgucauaacccaccaucuccugaaggacccuuuguguaaaagauuuaaggugcaccaugcuguccagcaagccauugaacagaauuuagauuccaucauucugguguuccucgaggagaucccagacuacaaacugaaccacgcacuuugccugaggcggggcauguuuaagucacacuguauauugaauuggccgguucagaaagaacgcaucggugccuucagacauaagcuacaaguggcucuggggagcaagaacaguguacacuga

SEQ ID NO: 9590 - RNA, 2715 nt, Artificial Sequence
  derived and/or modified sequence opt4 from TLR3__Homo_sapiens__AAC34134
augagacagacccugcccugcaucuacuucuggggcggccugcugcccuucggcaugcugugcgccagcagcaccaccaagugcaccgugagccacgagguggccgacugcagccaccugaagcugacccaggugcccgacgaccugcccaccaacaucaccgugcugaaccugacccacaaccagcugagaagacugcccgccgccaacuucaccagauacagccagcugaccagccuggacgugggcuucaacaccaucagcaagcuggagcccgagcugugccagaagcugcccaugcugaaggugcugaaccugcagcacaacgagcugagccagcugagcgacaagaccuucgccuucugcaccaaccugaccgagcugcaccugaugagcaacagcauccagaagaucaagaacaaccccuucgugaagcagaagaaccugaucacccuggaccugagccacaacggccugagcagcaccaagcugggcacccaggugcagcuggagaaccugcaggagcugcugcugagcaacaacaagauccaggcccugaagagcgaggagcuggacaucuucgccaacagcagccugaagaagcuggagcugagcagcaaccagaucaaggaguucagccccggcugcuuccacgccaucggcagacuguucggccuguuccugaacaacgugcagcugggccccagccugaccgagaagcugugccuggagcuggccaacaccagcaucagaaaccugagccugagcaacagccagcugagcaccaccagcaacaccaccuuccugggccugaaguggaccaaccugaccaugcuggaccugagcuacaacaaccugaacguggugggcaacgacagcuucgccuggcugccccagcuggaguacuucuuccuggaguacaacaacauccagcaccuguucagccacagccugcacggccuguucaacgugagauaccugaaccugaagagaagcuucaccaagcagagcaucagccuggccagccugcccaagaucgacgacuucagcuuccaguggcugaagugccuggagcaccugaacauggaggacaacgacauccccggcaucaagagcaacauguucaccggccugaucaaccugaaguaccugagccugagcaacagcuucaccagccugagaacccugaccaacgagaccuucgugagccuggcccacagcccccugcacauccugaaccugaccaagaacaagaucagcaagaucgagagcgacgccuucagcuggcugggccaccuggaggugcuggaccugggccugaacgagaucggccaggagcugaccggccaggaguggagaggccuggagaacaucuucgagaucuaccugagcuacaacaaguaccugcagcugaccagaaacagcuucgcccuggugcccagccugcagagacugaugcugagaagaguggcccugaagaacguggacagcagccccagccccuuccagccccugagaaaccugaccauccuggaccugagcaacaacaacaucgccaacaucaacgacgacaugcuggagggccuggagaagcuggagauccuggaccugcagcacaacaaccuggccagacuguggaagcacgccaaccccggcggccccaucuacuuccugaagggccugagccaccugcacauccugaaccuggagagcaacggcuucgacgagauccccguggagguguucaaggaccuguucgagcugaagaucaucgaccugggccugaacaaccugaacacccugcccgccagcguguucaacaaccaggugagccugaagagccugaaccugcagaagaaccugaucaccagcguggagaagaagguguucggccccgccuucagaaaccugaccgagcuggacaugagauucaaccccuucgacugcaccugcgagagcaucgccugguucgugaacuggaucaacgagacccacaccaacauccccgagcugagcagccacuaccugugcaacacccccccccacuaccacggcuuccccgugagacuguucgacaccagcagcugcaaggacagcgcccccuucgagcuguucuucaugaucaacaccagcauccugcugaucuucaucuucaucgugcugcugauccacuucgagggcuggagaaucagcuucuacuggaacgugagcgugcacagagugcugggcuucaaggagaucgacagacagaccgagcaguucgaguacgccgccuacaucauccacgccuacaaggacaaggacugggugugggagcacuucagcagcauggagaaggaggaccagagccugaaguucugccuggaggagagagacuucgaggccggcguguucgagcuggaggccaucgugaacagcaucaagagaagcagaaagaucaucuucgugaucacccaccaccugcugaaggacccccugugcaagagauucaaggugcaccacgccgugcagcaggccaucgagcagaaccuggacagcaucauccugguguuccuggaggagauccccgacuacaagcugaaccacgcccugugccugagaagaggcauguucaagagccacugcauccugaacuggcccgugcagaaggagagaaucggcgccuucagacacaagcugcagguggcccugggcagcaagaacagcgugcacuga

SEQ ID NO: 9591 - RNA, 2715 nt, Artificial Sequence
  derived and/or modified sequence opt5 from TLR3__Homo_sapiens__AAC34134
augagacagacccugcccugcaucuacuucuggggcgggcuccugccuuuuggaaugcuuugugccagcuccacaacgaagugcaccgugucucacgaggucgcugacuguagccaucugaaacucacacaaguuccggaugaccugcccaccaacauuacagugcuuaaucugacccacaaccagcuccggcgccugccugccgcgaauuucacaagauauucccagcugaccucucucgaugugggcuuuaacacgaucagcaagcuggaacccgagcuuugccagaaacugccuaugcucaagguccugaaucuucaacauaacgaacugucccagcucucugacaaaaccuucgcuuuuuguacaaaucugaccgagcugcaccucaugagcaacuccauucagaagaucaagaauaaccccuucgugaaacagaagaaucugauuacacuugaucugagccauaacgggcucucuuccaccaaacugggaacgcaaguucagcuugaaaaucugcaggagcuccugcugagcaacaauaagauccaggcccucaaaucugaggaacuggacaucuuugccaacuccagccuuaagaagcuggagcucucuuccaaccaaauuaaagaguucagcccuggcugcuuucacgcuaucgggcggcuguucggacuuuuucugaauaacgugcagcucggcccgucccugacagaaaagcugugucucgagcuggccaauaccucuauucgcaaccuuagccuguccaauagccagcucucuacaaccuccaacaccacauuccugggccugaaauggacgaaucuuaccaugcucgaucugagcuacaacaaucugaacgucguggggaaugacucuuuugcuuggcucccccaacuggaauauuucuuccuugaguacaacaauauccagcaccuguuuagccauucccuccacggacuguucaacguuagauaucugaaucuuaagcggucuuuuacaaaacagagcauuucccucgccagccugccuaagaucgaugacuucucuuuucaguggcugaaaugccucgaacaucugaacauggaggauaacgacauucccggcaucaaguccaauauguucaccgggcuuaucaaccugaaguaccucagccugucuaauuccuuuacaagccugcgcacccuuacgaacgaaacauucgugucccucgcgcacucuccucugcacauucugaaucucaccaaaaacaagaucagcaaaauugaguccgaugccuuuucuuggcugggacaucuugagguccuggaccucggccugaaugaaaucgggcaagagcugaccggacaggaauggagaggccuugagaacauuuucgaaaucuaucucagcuacaauaaguaccugcagcugacacggaacuccuuugcucucgugcccagccugcagcgccuuaugcugagacggguggcccucaaaaaugucgacucuuccccgagcccuuuccaaccccugcgcaaccugaccauccuugaucugucuaauaacaauauugcuaacaucaacgacgauaugcucgagggccuggagaagcucgaaauucuggaccuucagcacaauaaccuggccagacucuggaagcaugcgaauccugggggacccaucuauuuucugaaaggccugucccaccuucauauucugaaccucgagagcaauggguucgaugaaauccccguugagguguucaaggaccuguuugaacucaaaaucauugaucugggacuuaacaaucugaacacacucccugccucuguguucaauaaccaggucagccugaagucccugaaucuucagaaaaaccugaucacgagcguggagaagaagguuuuuggcccggcuuuccggaaucucaccgagcuggacaugcgcuuuaaccccuucgauuguacaugcgaaucuauugccugguuugugaauuggaucaacgagacccacacaaacauuccugaacucuccagccacuaccuguguaauacgcccccucauuaucacggguuccccgucagacuuuuugacaccuccucuugcaaagauagcgcuccguucgagcuguuuuucaugaucaacaccuccauucugcucaucuuuaucuucauugugcugcuuauccauuucgagggauggcggauuucuuuuuacuggaauguuagcgugcacagaguccugggcuucaaggaaaucgaccgccaaacagagcaguuugaauaugccgccuacauuauccacgcuuauaaagacaaggauugggugugggagcauuucuccucuauggaaaaagaggaccagagccucaaguuuugccuggaggaacgggauuucgaggcgggcgucuuugaacucgaggccaucgugaacuccauuaagagaagccgcaaaaucauuuucguuaucacccaccaucugcuuaaggacccucuguguaaacgguuuaaggugcaccaugcuguccagcaagccauugaacagaaucuggauucuaucauccucguguuccuggaggagauucccgacuacaaacuuaaccacgcccugugccucagacgcgggauguuuaagucccacuguauccugaauuggccuguucagaaagaacggauuggagcuuucagacauaagcuccaaguggcccugggcagcaagaacucuguccacuga

SEQ ID NO: 9592 - protein, 839 aa, Artificial Sequence [sequence omitted]

SEQ ID NO: 9593 - RNA, 2520 nt, Artificial Sequence
  TLR4__Homo_sapiens__AAY82270
augaugucugccucgcgccuggcugggacucugaucccagccauggccuuccucuccugcgugagaccagaaagcugggagcccugcguggaggugguuccuaauauuacuuaucaaugcauggagcugaauuucuacaaaauccccgacaaccuccccuucucaaccaagaaccuggaccugagcuuuaauccccugaggcauuuaggcagcuauagcuucuucaguuucccagaacugcaggugcuggauuuauccaggugugaaauccagacaauugaagauggggcauaucagagccuaagccaccucucuaccuuaauauugacaggaaaccccauccagaguuuagcccugggagccuuuucuggacuaucaaguuuacagaagcugguggcuguggagacaaaucuagcaucucuagagaacuuccccauuggacaucucaaaacuuugaaagaacuuaauguggcucacaaucuuauccaaucuuucaaauuaccugaguauuuuucuaaucugaccaaucuagagcacuuggaccuuuccagcaacaagauucaaaguauuuauugcacagacuugcggguucuacaucaaaugccccuacucaaucucucuuuagaccugucccugaacccuaugaacuuuauccaaccaggugcauuuaaagaaauuaggcuucauaagcugacuuuaagaaauaauuuugauaguuuaaauguaaugaaaacuuguauucaaggucuggcugguuuagaaguccaucguuugguucugggagaauuuagaaaugaaggaaacuuggaaaaguuugacaaaucugcucuagagggccuguacaauuugaccauugaagaauuccgauuagcauacuuagacuacuaccucgaugauauuauugacuuauuuaauuguuugacaaauguuucuucauuuucccuggugagugugacuauugaaaggguaaaagacuuuucuuauaauuucggauggcaacauuuagaauuaguuaacuguaaauuuggacaguuucccacauugaaacucaaaucucucaaaaggcuuacuuucacuuccaacaaaggugggaaugcuuuuucagaaguugaucuaccaagccuugaguuucuagaucucaguagaaauggcuugaguuucaaagguugcuguucucaaagugauuuugggacaaccagccuaaaguauuuagaucugagcuucaaugguguuauuaccaugaguucaaacuucuugggcuuagaacaacuagaacaucuggauuuccagcauuccaauuugaaacaaaugagugaguuuucaguauuccuaucacucagaaaccucauuuaccuugacauuucucauacucacaccagaguugcuuucaauggcaucuucaauggcuuguccagucucgaagucuugaaaauggcuggcaauucuuuccaggaaaacuuccuuccagauaucuucacagagcugagaaacuugaccuuccuggaccucucucagugucaacuggagcaguugucuccaacagcauuuaacucacucuccagucuucagguacuaaauaugagccacaacaacuucuuuucauuggauacguuuccuuauaagugucugaacucccuccagguucuugauuacagucucaaucacauaaugacuuccaaaaaacaggaacuacagcauuuuccaaguagucuagcuuucuuaaaucuuacucagaaugacuuugcuuguacuugugaacaccagaguuuccugcaauggaucaaggaccagaggcagcucuugguggaaguugaacgaauggaaugugcaacaccuucagauaagcagggcaugccugugcugaguuugaauaucaccugucagaugaauaagaccaucauuggugugucgguccucagugugcuuguaguaucuguuguagcaguucuggucuauaaguucuauuuucaccugaugcuucuugcuggcugcauaaaguaugguagaggugaaaacaucuaugaugccuuuguuaucuacucaagccaggaugaggacuggguaaggaaugagcuaguaaagaauuuagaagaaggggugccuccauuucagcucugccuucacuacagagacuuuauucccgguguggccauugcugccaacaucauccaugaagguuuccauaaaagccgaaaggugauuguuguggugucccagcacuucauccagagccgcugguguaucuuugaauaugagauugcucagaccuggcaguuucugagcagucgugcugguaucaucuucauuguccugcagaagguggagaagacccugcucaggcagcagguggagcuguaccgccuucucagcaggaacacuuaccuggagugggaggacaguguccuggggcggcacaucuucuggagacgacucagaaaagcccugcuggaugguaaaucauggaauccagaaggaacaguggguacaggaugcaauuggcaggaagcaacaucuaucuga

SEQ ID NO: 9594 - RNA, 2520 nt, Artificial Sequence
  derived and/or modified sequence opt1 from TLR4__Homo_sapiens__AAY82270
augaugagcgccucccgccuggccggcacccucauccccgcgauggccuuccugagcugcgugcggccggaguccugggagcccugcgucgagguggugcccaacaucaccuaccagugcauggagcugaacuucuacaagauccccgacaaccucccguucagcacgaagaaccuggaccuguccuucaacccccuccgccaccuggggagcuacuccuucuucagcuuccccgagcugcagguccucgaccugucccggugcgagauccagaccaucgaggacggcgccuaccagagccugucccaccucagcacccugauccugaccgggaaccccauccagucccucgcccugggcgccuucagcgggcuguccagccuccagaagcugguggcgguggagacgaaccuggccucccucgagaacuucccgaucggccaccugaagacccugaaggagcucaacgucgcccacaaccugauccagagcuucaagcugcccgaguacuucuccaaccucaccaaccuggagcaccuggaccucagcagcaacaagauccaguccaucuacugcaccgaccugcgcgugcugcaccagaugccccuccugaaccugagccucgaccugucccugaaccccaugaacuucauccagccgggcgccuucaaggagauccggcuccacaagcugacgcugcgcaacaacuucgacagccucaacgugaugaagaccugcauccaggggcuggcgggccuggagguccaccggcucgugcugggggaguuccgcaacgagggcaaccuggagaaguucgacaaguccgcccucgaggggcuguacaaccugaccaucgaggaguuccggcuggccuaccucgacuacuaccuggacgacaucaucgaccuguucaacugccucaccaacgugagcuccuucagccuggucuccgugacgaucgagcgcgugaaggacuucagcuacaacuucggcuggcagcaccuggagcucgucaacugcaaguucggccaguuccccacccugaagcugaagucccucaagcggcugaccuucaccagcaacaagggcgggaacgccuucuccgagguggaccugcccagccucgaguuccuggaccugucccgcaacgggcucagcuucaagggcugcugcucccagagcgacuucggcacgaccucccugaaguaccuggaccucagcuucaacggggugaucaccaugagcuccaacuuccugggccuggagcagcucgagcaccuggacuuccagcacagcaaccugaagcagauguccgaguucagcgucuuccucucccugcggaaccugaucuaccucgacaucagccacacccacacgcgcguggccuucaacgggaucuucaacggccuguccagccuggaggugcucaagauggcggggaacuccuuccaggagaacuuccugcccgacaucuucaccgagcugcggaaccucaccuuccuggaccugagccagugccagcucgagcagcuguccccgaccgccuucaacagccuguccagccuccagguccugaacaugucccacaacaacuucuucagccuggacacguuccccuacaagugccucaacucccuccaggugcuggacuacagccugaaccacaucaugaccagcaagaagcaggagcugcagcacuuccccuccagccuggccuuccucaaccugacccagaacgacuucgccugcacgugcgagcaccaguccuuccugcaguggaucaaggaccagcgccagcuccugguggaggucgagcggauggagugcgccacccccagcgacaagcagggcaugccggugcugucccucaacaucacgugccagaugaacaagaccaucaucggcgucagcgugcuguccgugcuggucgugagcguggucgcggugcucguguacaaguucuacuuccaccugaugcugcucgccgggugcaucaaguacggccgcggggagaacaucuacgacgccuucgucaucuacuccagccaggacgaggacugggugcggaacgagcuggugaagaaccuggaggagggcgucccgcccuuccagcucugccugcacuaccgcgacuucauccccgggguggccaucgccgcgaacaucauccacgagggcuuccacaagucccggaaggugaucgucguggugagccagcacuucauccagucccgcuggugcaucuucgaguacgagaucgcccagaccuggcaguuccugagcucccgcgccggcaucaucuucaucguccuccagaagguggagaagacccugcugcggcagcaggucgagcucuaccgccugcugagccggaacaccuaccucgagugggaggacuccgugcuggggcgccacaucuucuggcggcgccugcggaaggcccuccuggacggcaagagcuggaaccccgaggggaccgugggcaccgggugcaacuggcaggaggccacguccaucuga

SEQ ID NO: 9595 - RNA, 2520 nt, Artificial Sequence
  derived and/or modified sequence opt2 from TLR4__Homo_sapiens__AAY82270
augauguccgccucccgccucgccggcacccucauccccgccauggccuuccucuccugcguccgccccgaguccugggagcccugcgucgaggucguccccaacaucaccuaccagugcauggagcucaacuucuacaagauccccgacaaccuccccuucuccaccaagaaccucgaccucuccuucaacccccuccgccaccucggcuccuacuccuucuucuccuuccccgagcuccagguccucgaccucucccgcugcgagauccagaccaucgaggacggcgccuaccagucccucucccaccucuccacccucauccucaccggcaaccccauccagucccucgcccucggcgccuucuccggccucuccucccuccagaagcucgucgccgucgagaccaaccucgccucccucgagaacuuccccaucggccaccucaagacccucaaggagcucaacgucgcccacaaccucauccaguccuucaagcuccccgaguacuucuccaaccucaccaaccucgagcaccucgaccucuccuccaacaagauccaguccaucuacugcaccgaccuccgcguccuccaccagaugccccuccucaaccucucccucgaccucucccucaaccccaugaacuucauccagcccggcgccuucaaggagauccgccuccacaagcucacccuccgcaacaacuucgacucccucaacgucaugaagaccugcauccagggccucgccggccucgagguccaccgccucguccucggcgaguuccgcaacgagggcaaccucgagaaguucgacaaguccgcccucgagggccucuacaaccucaccaucgaggaguuccgccucgccuaccucgacuacuaccucgacgacaucaucgaccucuucaacugccucaccaacgucuccuccuucucccucgucuccgucaccaucgagcgcgucaaggacuucuccuacaacuucggcuggcagcaccucgagcucgucaacugcaaguucggccaguuccccacccucaagcucaagucccucaagcgccucaccuucaccuccaacaagggcggcaacgccuucuccgaggucgaccuccccucccucgaguuccucgaccucucccgcaacggccucuccuucaagggcugcugcucccaguccgacuucggcaccaccucccucaaguaccucgaccucuccuucaacggcgucaucaccauguccuccaacuuccucggccucgagcagcucgagcaccucgacuuccagcacuccaaccucaagcagauguccgaguucuccgucuuccucucccuccgcaaccucaucuaccucgacaucucccacacccacacccgcgucgccuucaacggcaucuucaacggccucuccucccucgagguccucaagauggccggcaacuccuuccaggagaacuuccuccccgacaucuucaccgagcuccgcaaccucaccuuccucgaccucucccagugccagcucgagcagcucucccccaccgccuucaacucccucuccucccuccagguccucaacaugucccacaacaacuucuucucccucgacaccuuccccuacaagugccucaacucccuccagguccucgacuacucccucaaccacaucaugaccuccaagaagcaggagcuccagcacuuccccuccucccucgccuuccucaaccucacccagaacgacuucgccugcaccugcgagcaccaguccuuccuccaguggaucaaggaccagcgccagcuccucgucgaggucgagcgcauggagugcgccacccccuccgacaagcagggcaugcccguccucucccucaacaucaccugccagaugaacaagaccaucaucggcgucuccguccucuccguccucgucgucuccgucgucgccguccucgucuacaaguucuacuuccaccucaugcuccucgccggcugcaucaaguacggccgcggcgagaacaucuacgacgccuucgucaucuacuccucccaggacgaggacuggguccgcaacgagcucgucaagaaccucgaggagggcgucccccccuuccagcucugccuccacuaccgcgacuucauccccggcgucgccaucgccgccaacaucauccacgagggcuuccacaagucccgcaaggucaucgucgucgucucccagcacuucauccagucccgcuggugcaucuucgaguacgagaucgcccagaccuggcaguuccucuccucccgcgccggcaucaucuucaucguccuccagaaggucgagaagacccuccuccgccagcaggucgagcucuaccgccuccucucccgcaacaccuaccucgagugggaggacuccguccucggccgccacaucuucuggcgccgccuccgcaaggcccuccucgacggcaaguccuggaaccccgagggcaccgucggcaccggcugcaacuggcaggaggccaccuccaucuga

SEQ ID NO: 9596 - RNA, 2520 nt, Artificial Sequence
  derived and/or modified sequence opt3 from TLR4__Homo_sapiens__AAY82270
augaugagcgccuccagacuggcuggcacccucauccccgcaauggccuuccuuucuugcgugaggccugagucaugggaaccaugugucgagguugugccgaacauuacauaccagugcauggaacugaauuuuuauaagauacccgacaacuugccuuucaguacuaaaaauuuagaucugagcuuuaacccacuacggcaccucggguccuacucuuucuuuucguuccccgagcugcaaguacuugaccugucacgcugugaaauccagacgauugaggauggagcguaucagagcuugagucaucucuccacccugauccugacagguaauccuauucagucucucgcuuuaggcgccuuuagcgggcuguccucacuucaaaaguugguggcagucgagacuaaccuggccagucuagaaaauuucccaaucggacaccucaaaacccugaaggagcuuaacguggcucauaaucugauacagagcuuuaaauugcccgaauacuucucuaaccucacaaaucuggagcacuuagaccuguccucaaacaagauccagagcauuuauugcaccgaucuccgaguucuucaucagaugccucuguugaaucuaagucuggaccucucucugaacccaaugaauuuuauccaaccgggcgcauucaaggagauucgucuucacaaacugacuuugagaaacaacuuugauucccucaaugugaugaagacauguauccagggucuggccggguuagaaguccacaggcuggugcuaggagaguuccggaacgaaggcaaucucgagaaauucgacaagagcgcucuggaaggccuuuacaacuugaccauagaggaguuucgccuggccuaucucgauuacuaccuggacgauauuaucgaccuuuucaauugccugacgaacguaucgucuuuuuccuugguuucagugacuauugaaagagucaaagauuucaguuauaauuuuggguggcagcaucucgagcuggugaacuguaaguucggacaguuucccaccuuaaagcugaaaagccuaaagaggcucacauucacuuccaauaaagguggcaacgcguuuucugaaguggaccugccuagccuugaguucuuggaccugucacggaaugggcucaguuuuaagggaugcuguucccaaagcgauuucggcaccacaucucugaaauacuuagaccugucauuuaacggugucaucaccaugaguagcaauuuccuuggguuggaacagcucgagcaccuggauuuccagcauuccaaccuaaagcaaaugucugaguuuucgguuuuccugagccuccgcaaucugaucuaucuugacauuucccacacgcacacucgaguggcauuuaacggaauauucaacggcuugucaagucuggaaguauuaaaaauggccggcaauucuuuucaggagaacuuccucccagauaucuuuacagaacugagaaaucuuaccuuccuggacuugagccagugccagcucgagcaacugucccccacugcuuuuaacucacuaagcucucuccaggugcugaauaugucccauaacaauuucuuuagucuggauacauucccuuacaagugucuuaacagcuugcagguccuggacuauucuuuaaaucacauuaugaccuccaagaaacaggaacuccaacauuuuccaucaagucuggccuuccuuaaccugacgcagaaugauuucgcauguaccugcgagcaccagagcuuucuacaguggaucaaggaccaaaggcagcuccugguggagguugaacggauggagugcgcuacacccucggauaaacaggggaugccgguguugucccugaacauaacuugccagaugaauaagaccauuaucggagucucuguguuaagcguacucguugugucagucguggccguccugguguacaaauucuauuuucaucuuaugcuguuggcggguuguaucaaguacggccguggggaaaacauuuacgacgccuucguuaucuauaguucccaagacgaggauugggugcgcaaugagcucguaaagaaccuggaagagggagucccucccuuucagcuaugccugcacuacagagacuucauuccaggcguggcaauagcugccaacaucauucacgaagguuuucauaaaucuaggaagguuaucguggucgugagccagcacuucauccaaucccggugguguauuuuugaguaugaaauagcucagacauggcaguuccuuucaagccgagccgggaucauuuuuaucguacuccagaaaguggagaagacucuguugcgccaacagguugagcuguacagauuacucaguaggaauaccuaucuggaaugggaggauucuguccuuggccggcauauuuucuggcgcagacugaggaaagcauugcucgacggaaaguccuggaacccugaaggcacaguggggaccggaugcaauuggcaggaggccacuagcaucuga

SEQ ID NO: 9597 - RNA, 2520 nt, Artificial Sequence
  derived and/or modified sequence opt4 from TLR4__Homo_sapiens__AAY82270
augaugagcgccagcagacuggccggcacccugauccccgccauggccuuccugagcugcgugagacccgagagcugggagcccugcguggagguggugcccaacaucaccuaccagugcauggagcugaacuucuacaagauccccgacaaccugcccuucagcaccaagaaccuggaccugagcuucaacccccugagacaccugggcagcuacagcuucuucagcuuccccgagcugcaggugcuggaccugagcagaugcgagauccagaccaucgaggacggcgccuaccagagccugagccaccugagcacccugauccugaccggcaaccccauccagagccuggcccugggcgccuucagcggccugagcagccugcagaagcugguggccguggagaccaaccuggccagccuggagaacuuccccaucggccaccugaagacccugaaggagcugaacguggcccacaaccugauccagagcuucaagcugcccgaguacuucagcaaccugaccaaccuggagcaccuggaccugagcagcaacaagauccagagcaucuacugcaccgaccugagagugcugcaccagaugccccugcugaaccugagccuggaccugagccugaaccccaugaacuucauccagcccggcgccuucaaggagaucagacugcacaagcugacccugagaaacaacuucgacagccugaacgugaugaagaccugcauccagggccuggccggccuggaggugcacagacuggugcugggcgaguucagaaacgagggcaaccuggagaaguucgacaagagcgcccuggagggccuguacaaccugaccaucgaggaguucagacuggccuaccuggacuacuaccuggacgacaucaucgaccuguucaacugccugaccaacgugagcagcuucagccuggugagcgugaccaucgagagagugaaggacuucagcuacaacuucggcuggcagcaccuggagcuggugaacugcaaguucggccaguuccccacccugaagcugaagagccugaagagacugaccuucaccagcaacaagggcggcaacgccuucagcgagguggaccugcccagccuggaguuccuggaccugagcagaaacggccugagcuucaagggcugcugcagccagagcgacuucggcaccaccagccugaaguaccuggaccugagcuucaacggcgugaucaccaugagcagcaacuuccugggccuggagcagcuggagcaccuggacuuccagcacagcaaccugaagcagaugagcgaguucagcguguuccugagccugagaaaccugaucuaccuggacaucagccacacccacaccagaguggccuucaacggcaucuucaacggccugagcagccuggaggugcugaagauggccggcaacagcuuccaggagaacuuccugcccgacaucuucaccgagcugagaaaccugaccuuccuggaccugagccagugccagcuggagcagcugagccccaccgccuucaacagccugagcagccugcaggugcugaacaugagccacaacaacuucuucagccuggacaccuuccccuacaagugccugaacagccugcaggugcuggacuacagccugaaccacaucaugaccagcaagaagcaggagcugcagcacuuccccagcagccuggccuuccugaaccugacccagaacgacuucgccugcaccugcgagcaccagagcuuccugcaguggaucaaggaccagagacagcugcugguggagguggagagaauggagugcgccacccccagcgacaagcagggcaugcccgugcugagccugaacaucaccugccagaugaacaagaccaucaucggcgugagcgugcugagcgugcugguggugagcgugguggccgugcugguguacaaguucuacuuccaccugaugcugcuggccggcugcaucaaguacggcagaggcgagaacaucuacgacgccuucgugaucuacagcagccaggacgaggacugggugagaaacgagcuggugaagaaccuggaggagggcgugccccccuuccagcugugccugcacuacagagacuucauccccggcguggccaucgccgccaacaucauccacgagggcuuccacaagagcagaaaggugaucgugguggugagccagcacuucauccagagcagauggugcaucuucgaguacgagaucgcccagaccuggcaguuccugagcagcagagccggcaucaucuucaucgugcugcagaagguggagaagacccugcugagacagcagguggagcuguacagacugcugagcagaaacaccuaccuggagugggaggacagcgugcugggcagacacaucuucuggagaagacugagaaaggcccugcuggacggcaagagcuggaaccccgagggcaccgugggcaccggcugcaacuggcaggaggccaccagcaucuga

SEQ ID NO: 9598 - RNA, 2520 nt, Artificial Sequence
  derived and/or modified sequence opt5 from TLR4__Homo_sapiens__AAY82270
augaugagcgccuccagacuggcuggcacccucauccccgccauggcguuccugucuugcgugcggccugagagcugggaaccgugugucgagguugugcccaacauuacauaccagugcauggaacuuaauuuuuauaagaucccugacaaccugcccuucuccacgaaaaaucucgaucugucuuuuaacccucuucgccaccuggggagcuacuccuucuuuucuuuccccgagcuccaagugcuggaccugagcagaugugaaauucagaccaucgaggauggagcuuaucagucccucagccaucugucuacacuuauucugaccggcaauccuauccagucccucgcccugggggccuuuagcggacuuucuucccugcaaaagcucgucgcuguggagacaaaccuggccagccuggaaaauuucccgaucggccaccucaaaacccugaaggagcuuaacguugcucauaaucugauucagucuuuuaaacuccccgaauacuucuccaaccugacaaaucuugagcaccuggaccucagcuccaacaagauccagucuauuuauugcaccgaucugcgggugcugcaucagaugccucuccugaaucuuagccuggaccucucccugaaccccaugaauuuuauccaaccuggggccuucaaggagauucgccuucacaaacugacgcucagaaacaacuuugauagccugaaugucaugaagaccuguauccagggacuggcgggccucgaagugcaccggcugguucuuggcgaguuccgcaacgaagggaaucuggagaaauucgacaagucugcccucgaaggacuguacaaccugacaauugaggaguuuagacuugcuuaucucgauuacuaccuggacgauaucaucgaccuguucaauugccucaccaacguguccagcuuuucucuggucagcgugacaauugaacgggugaaagauuucuccuauaauuuuggcuggcagcaucuugagcuggucaacuguaaguucgggcaguuucccacccucaagcugaaaucucugaagcgccuuacguucacaagcaauaaaggaggcaacgccuuuuccgaaguugaccucccgagccuggaguuccuggaccucucuagaaaugggcuguccuuuaagggaugcuguagccaaucugauuucggcaccacaucccuuaaauaccuggaccucagcuuuaacggcgugaucaccauguccucuaauuuccuggggcuggaacagcuugagcaccucgauuuccagcauagcaaccugaagcaaauguccgaguuuucuguguuccugagccuccggaaucugauuuaucuugacaucucccacacccacacacgcgucgcuuuuaacggaauuuucaacggccugagcucucucgaagugcugaaaauggccggaaauuccuuucaggagaacuuccugccugauaucuuuacggaacuuagaaaucucaccuuccuggaccugagccagugccagcucgagcaacugucucccacagcguuuaacucccuuagcucucugcagguucucaauaugagccauaacaauuucuuuucccuggauaccuucccuuacaagugucugaacagccuucaggugcuggacuauucucucaaucacaucaugacauccaagaaacaggaacugcaacauuuucccagcucccucgccuuccugaaccuuacccagaaugauuucgcuugcacgugcgagcaccagucuuuucugcaguggauuaaggaccaacggcagcuccuggucgagguggaacgcauggagugugccacacccagcgauaaacaggggaugccuguucugucccuuaacauuaccugccagaugaauaagaccaucaucggcgugucuguccugagcgugcucgucguguccguuguggcuguccugguguacaaauucuauuuucaucucaugcugcuugccggguguauuaaguacggaagaggcgaaaacaucuacgacgccuucguuaucuauucuagccaagacgaggauugggugcggaaugagcuggucaagaaccucgaagagggcgugccgcccuuucagcugugccugcacuacagagacuucauuccugggguggcuaucgcggccaacauuauccacgaaggauuucauaaaucccgcaagguuauugucguggugagccagcacuucauccaaucucggugguguauuuuugaguaugaaaucgcucagacauggcaguuccuuuccagcagagccggcaucauuuuuaucguccugcagaaaguggagaagacccuccugcgccaacagguugagcucuaccggcugcuuucuagaaauacauaucuggaaugggaggauuccgugcuggggcgccauauuuucuggcggagacuccgcaaagcccugcuugacggaaagagcuggaaccccgaaggcacggucgggaccggcugcaauuggcaggaggcuacaucuaucuga

SEQ ID NO: 9599 - protein, 839 aa, Artificial Sequence
  TLR4__Homo_sapiens__O00206
MMSASRLAGTLIPAMAFLSCVRPESWEPCVEVVPNITYQCMELNFYKIPDNLPFSTKNLDLSFNPLRHLGSYSFFSFPELQVLDLSRCEIQTIEDGAYQSLSHLSTLILTGNPIQSLALGAFSGLSSLQKLVAVETNLASLENFPIGHLKTLKELNVAHNLIQSFKLPEYFSNLTNLEHLDLSSNKIQSIYCTDLRVLHQMPLLNLSLDLSLNPMNFIQPGAFKEIRLHKLTLRNNFDSLNVMKTCIQGLAGLEVHRLVLGEFRNEGNLEKFDKSALEGLCNLTIEEFRLAYLDYYLDDIIDLFNCLTNVSSFSLVSVTIERVKDFSYNFGWQHLELVNCKFGQFPTLKLKSLKRLTFTSNKGGNAFSEVDLPSLEFLDLSRNGLSFKGCCSQSDFGTTSLKYLDLSFNGVITMSSNFLGLEQLEHLDFQHSNLKQMSEFSVFLSLRNLIYLDISHTHTRVAFNGIFNGLSSLEVLKMAGNSFQENFLPDIFTELRNLTFLDLSQCQLEQLSPTAFNSLSSLQVLNMSHNNFFSLDTFPYKCLNSLQVLDYSLNHIMTSKKQELQHFPSSLAFLNLTQNDFACTCEHQSFLQWIKDQRQLLVEVERMECATPSDKQGMPVLSLNITCQMNKTIIGVSVLSVLVVSVVAVLVYKFYFHLMLLAGCIKYGRGENIYDAFVIYSSQDEDWVRNELVKNLEEGVPPFQLCLHYRDFIPGVAIAANIIHEGFHKSRKVIVVVSQHFIQSRWCIFEYEIAQTWQFLSSRAGIIFIVLQKVEKTLLRQQVELYRLLSRNTYLEWEDSVLGRHIFWRRLRKALLDGKSWNPEGTVGTGCNWQEATSI

SEQ ID NO: 9600 - RNA, 2520 nt, Artificial Sequence
  TLR4__Homo_sapiens__AAC80227
augaugucugccucgcgccuggcugggacucugaucccagccauggccuuccucuccugcgugagaccagaaagcugggagcccugcguggaggugguuccuaauauuacuuaucaaugcauggagcugaauuucuacaaaauccccgacaaccuccccuucucaaccaagaaccuggaccugagcuuuaauccccugaggcauuuaggcagcuauagcuucuucaguuucccagaacugcaggugcuggauuuauccaggugugaaauccagacaauugaagauggggcauaucagagccuaagccaccucucuaccuuaauauugacaggaaaccccauccagaguuuagcccugggagccuuuucuggacuaucaaguuuacagaagcugguggcuguggagacaaaucuagcaucucuagagaacuuccccauuggacaucucaaaacuuugaaagaacuuaauguggcucacaaucuuauccaaucuuucaaauuaccugaguauuuuucuaaucugaccaaucuagagcacuuggaccuuuccagcaacaagauucaaaguauuuauugcacagacuugcggguucuacaucaaaugccccuacucaaucucucuuuagaccugucccugaauccuaugaacuuuauccaaccaggugcauuuaaagaaauuaggcuucauaagcugacuuuaagaaauaauuuugauaguuuaaauguaaugaaaacuuguauucaaggucuggcugguuuagaaguccaucguuugguucugggagaauuuagaaaugaaggaaacuuggaaaaguuugacaaaucugcucuagagggccugugcaauuugaccauugaagaauuccgauuagcauacuuagacuacuaccucgaugauauuauugacuuauuuaauuguuugacaaauguuucuucauuuucccuggugagugugacuauugaaaggguaaaagacuuuucuuauaauuucggauggcaacauuuagaauuaguuaacuguaaauuuggacaguuucccacauugaaacucaaaucucucaaaaggcuuacuuucacuuccaacaaaggugggaaugcuuuuucagaaguugaucuaccaagccuugaguuucuagaucucaguagaaauggcuugaguuucaaagguugcuguucucaaagugauuuugggacaaccagccuaaaguauuuagaucugagcuucaaugguguuauuaccaugaguucaaacuucuugggcuuagaacaacuagaacaucuggauuuccagcauuccaauuugaaacaaaugagugaguuuucaguauuccuaucacucagaaaccucauuuaccuugacauuucucauacucacaccagaguugcuuucaauggcaucuucaauggcuuguccagucucgaagucuugaaaauggcuggcaauucuuuccaggaaaacuuccuuccagauaucuucacagagcugagaaacuugaccuuccuggaccucucucagugucaacuggagcaguugucuccaacagcauuuaacucacucuccagucuucagguacuaaauaugagccacaacaacuucuuuucauuggauacguuuccuuauaagugucugaacucccuccagguucuugauuacagucucaaucacauaaugacuuccaaaaaacaggaacuacagcauuuuccaaguagucuagcuuucuuaaaucuuacucagaaugacuuugcuuguacuugugaacaccagaguuuccugcaauggaucaaggaccagaggcagcucuugguggaaguugaacgaauggaaugugcaacaccuucagauaagcagggcaugccugugcugaguuugaauaucaccugucagaugaauaagaccaucauuggugugucgguccucagugugcuuguaguaucuguuguagcaguucuggucuauaaguucuauuuucaccugaugcuucuugcuggcugcauaaaguaugguagaggugaaaacaucuaugaugccuuuguuaucuacucaagccaggaugaggacuggguaaggaaugagcuaguaaagaauuuagaagaaggggugccuccauuucagcucugccuucacuacagagacuuuauucccgguguggccauugcugccaacaucauccaugaagguuuccauaaaagccgaaaggugauuguuguggugucccagcacuucauccagagccgcugguguaucuuugaauaugagauugcucagaccuggcaguuucugagcagucgugcugguaucaucuucauuguccugcagaagguggagaagacccugcucaggcagcagguggagcuguaccgccuucucagcaggaacacuuaccuggagugggaggacaguguccuggggcggcacaucuucuggagacgacucagaaaagcccugcuggaugguaaaucauggaauccagaaggaacaguggguacaggaugcaauuggcaggaagcaacaucuaucuga

SEQ ID NO: 9601 - RNA, 2520 nt, Artificial Sequence
  derived and/or modified sequence opt1 from TLR4__Homo_sapiens__AAC80227
augaugagcgccucccgccuggccggcacccucauccccgcgauggccuuccugagcugcgugcggccggaguccugggagcccugcgucgagguggugcccaacaucaccuaccagugcauggagcugaacuucuacaagauccccgacaaccucccguucagcacgaagaaccuggaccuguccuucaacccccuccgccaccuggggagcuacuccuucuucagcuuccccgagcugcagguccucgaccugucccggugcgagauccagaccaucgaggacggcgccuaccagagccugucccaccucagcacccugauccugaccgggaaccccauccagucccucgcccugggcgccuucagcgggcuguccagccuccagaagcugguggcgguggagacgaaccuggccucccucgagaacuucccgaucggccaccugaagacccugaaggagcucaacgucgcccacaaccugauccagagcuucaagcugcccgaguacuucuccaaccucaccaaccuggagcaccuggaccucagcagcaacaagauccaguccaucuacugcaccgaccugcgcgugcugcaccagaugccccuccugaaccugagccucgaccugucccugaaccccaugaacuucauccagccgggcgccuucaaggagauccggcuccacaagcugacgcugcgcaacaacuucgacagccucaacgugaugaagaccugcauccaggggcuggcgggccuggagguccaccggcucgugcugggggaguuccgcaacgagggcaaccuggagaaguucgacaaguccgcccucgaggggcugugcaaccugaccaucgaggaguuccggcuggccuaccucgacuacuaccuggacgacaucaucgaccuguucaacugccucaccaacgugagcuccuucagccuggucuccgugacgaucgagcgcgugaaggacuucagcuacaacuucggcuggcagcaccuggagcucgucaacugcaaguucggccaguuccccacccugaagcugaagucccucaagcggcugaccuucaccagcaacaagggcgggaacgccuucuccgagguggaccugcccagccucgaguuccuggaccugucccgcaacgggcucagcuucaagggcugcugcucccagagcgacuucggcacgaccucccugaaguaccuggaccucagcuucaacggggugaucaccaugagcuccaacuuccugggccuggagcagcucgagcaccuggacuuccagcacagcaaccugaagcagauguccgaguucagcgucuuccucucccugcggaaccugaucuaccucgacaucagccacacccacacgcgcguggccuucaacgggaucuucaacggccuguccagccuggaggugcucaagauggcggggaacuccuuccaggagaacuuccugcccgacaucuucaccgagcugcggaaccucaccuuccuggaccugagccagugccagcucgagcagcuguccccgaccgccuucaacagccuguccagccuccagguccugaacaugucccacaacaacuucuucagccuggacacguuccccuacaagugccucaacucccuccaggugcuggacuacagccugaaccacaucaugaccagcaagaagcaggagcugcagcacuuccccuccagccuggccuuccucaaccugacccagaacgacuucgccugcacgugcgagcaccaguccuuccugcaguggaucaaggaccagcgccagcuccugguggaggucgagcggauggagugcgccacccccagcgacaagcagggcaugccggugcugucccucaacaucacgugccagaugaacaagaccaucaucggcgucagcgugcuguccgugcuggucgugagcguggucgcggugcucguguacaaguucuacuuccaccugaugcugcucgccgggugcaucaaguacggccgcggggagaacaucuacgacgccuucgucaucuacuccagccaggacgaggacugggugcggaacgagcuggugaagaaccuggaggagggcgucccgcccuuccagcucugccugcacuaccgcgacuucauccccgggguggccaucgccgcgaacaucauccacgagggcuuccacaagucccggaaggugaucgucguggugagccagcacuucauccagucccgcuggugcaucuucgaguacgagaucgcccagaccuggcaguuccugagcucccgcgccggcaucaucuucaucguccuccagaagguggagaagacccugcugcggcagcaggucgagcucuaccgccugcugagccggaacaccuaccucgagugggaggacuccgugcuggggcgccacaucuucuggcggcgccugcggaaggcccuccuggacggcaagagcuggaaccccgaggggaccgugggcaccgggugcaacuggcaggaggccacguccaucuga

SEQ ID NO: 9602 - RNA, 2520 nt, Artificial Sequence
  derived and/or modified sequence opt2 from TLR4__Homo_sapiens__AAC80227
augauguccgccucccgccucgccggcacccucauccccgccauggccuuccucuccugcguccgccccgaguccugggagcccugcgucgaggucguccccaacaucaccuaccagugcauggagcucaacuucuacaagauccccgacaaccuccccuucuccaccaagaaccucgaccucuccuucaacccccuccgccaccucggcuccuacuccuucuucuccuuccccgagcuccagguccucgaccucucccgcugcgagauccagaccaucgaggacggcgccuaccagucccucucccaccucuccacccucauccucaccggcaaccccauccagucccucgcccucggcgccuucuccggccucuccucccuccagaagcucgucgccgucgagaccaaccucgccucccucgagaacuuccccaucggccaccucaagacccucaaggagcucaacgucgcccacaaccucauccaguccuucaagcuccccgaguacuucuccaaccucaccaaccucgagcaccucgaccucuccuccaacaagauccaguccaucuacugcaccgaccuccgcguccuccaccagaugccccuccucaaccucucccucgaccucucccucaaccccaugaacuucauccagcccggcgccuucaaggagauccgccuccacaagcucacccuccgcaacaacuucgacucccucaacgucaugaagaccugcauccagggccucgccggccucgagguccaccgccucguccucggcgaguuccgcaacgagggcaaccucgagaaguucgacaaguccgcccucgagggccucugcaaccucaccaucgaggaguuccgccucgccuaccucgacuacuaccucgacgacaucaucgaccucuucaacugccucaccaacgucuccuccuucucccucgucuccgucaccaucgagcgcgucaaggacuucuccuacaacuucggcuggcagcaccucgagcucgucaacugcaaguucggccaguuccccacccucaagcucaagucccucaagcgccucaccuucaccuccaacaagggcggcaacgccuucuccgaggucgaccuccccucccucgaguuccucgaccucucccgcaacggccucuccuucaagggcugcugcucccaguccgacuucggcaccaccucccucaaguaccucgaccucuccuucaacggcgucaucaccauguccuccaacuuccucggccucgagcagcucgagcaccucgacuuccagcacuccaaccucaagcagauguccgaguucuccgucuuccucucccuccgcaaccucaucuaccucgacaucucccacacccacacccgcgucgccuucaacggcaucuucaacggccucuccucccucgagguccucaagauggccggcaacuccuuccaggagaacuuccuccccgacaucuucaccgagcuccgcaaccucaccuuccucgaccucucccagugccagcucgagcagcucucccccaccgccuucaacucccucuccucccuccagguccucaacaugucccacaacaacuucuucucccucgacaccuuccccuacaagugccucaacucccuccagguccucgacuacucccucaaccacaucaugaccuccaagaagcaggagcuccagcacuuccccuccucccucgccuuccucaaccucacccagaacgacuucgccugcaccugcgagcaccaguccuuccuccaguggaucaaggaccagcgccagcuccucgucgaggucgagcgcauggagugcgccacccccuccgacaagcagggcaugcccguccucucccucaacaucaccugccagaugaacaagaccaucaucggcgucuccguccucuccguccucgucgucuccgucgucgccguccucgucuacaaguucuacuuccaccucaugcuccucgccggcugcaucaaguacggccgcggcgagaacaucuacgacgccuucgucaucuacuccucccaggacgaggacuggguccgcaacgagcucgucaagaaccucgaggagggcgucccccccuuccagcucugccuccacuaccgcgacuucauccccggcgucgccaucgccgccaacaucauccacgagggcuuccacaagucccgcaaggucaucgucgucgucucccagcacuucauccagucccgcuggugcaucuucgaguacgagaucgcccagaccuggcaguuccucuccucccgcgccggcaucaucuucaucguccuccagaaggucgagaagacccuccuccgccagcaggucgagcucuaccgccuccucucccgcaacaccuaccucgagugggaggacuccguccucggccgccacaucuucuggcgccgccuccgcaaggcccuccucgacggcaaguccuggaaccccgagggcaccgucggcaccggcugcaacuggcaggaggccaccuccaucuga

SEQ ID NO: 9603 - RNA, 2520 nt, Artificial Sequence
  derived and/or modified sequence opt3 from TLR4__Homo_sapiens__AAC80227
augaugagcgccuccagacuggcuggcacccucauccccgcaauggccuuccuuucuugcgugaggccugagucaugggaaccaugugucgagguugugccgaacauuacauaccagugcauggaacugaauuuuuauaagauacccgacaacuugccuuucaguacuaaaaauuuagaucugagcuuuaacccacuacggcaccucggguccuacucuuucuuuucguuccccgagcugcaaguacuugaccugucacgcugugaaauccagacgauugaggauggagcguaucagagcuugagucaucucuccacccugauccugacagguaauccuauucagucucucgcuuuaggcgccuuuagcgggcuguccucacuucaaaaguugguggcagucgagacuaaccuggccagucuagaaaauuucccaaucggacaccucaaaacccugaaggagcuuaacguggcucauaaucugauacagagcuuuaaauugcccgaauacuucucuaaccucacaaaucuggagcacuuagaccuguccucaaacaagauccagagcauuuauugcaccgaucuccgaguucuucaucagaugccucuguugaaucuaagucuggaccucucucugaacccaaugaauuuuauccaaccgggcgcauucaaggagauucgucuucacaaacugacuuugagaaacaacuuugauucccucaaugugaugaagacauguauccagggucuggccggguuagaaguccacaggcuggugcuaggagaguuccggaacgaaggcaaucucgagaaauucgacaagagcgcucuggaaggccuuugcaacuugaccauagaggaguuucgccuggccuaccucgauuauuaccuggacgauauuaucgaccuuuucaauugucugacgaacguaucgucuuuuuccuugguuucagugacuauugaaagagucaaagauuucaguuacaauuuuggguggcagcaucucgagcuggugaacugcaaguucggacaguuucccaccuuaaagcugaaaagccuaaagaggcucacauucacuuccaauaaagguggcaacgcguuuucugaaguggaccugccuagccuugaguucuuggaccugucacggaaugggcucaguuuuaagggauguugcucccaaagcgauuucggcaccacaucucugaaauauuuagaccugucauuuaacggugucaucaccaugaguagcaauuuccuuggguuggaacagcucgagcaccuggauuuccagcauuccaaccuaaagcaaaugucugaguuuucgguuuuccugagccuccgcaaucugaucuaccuugacauuucccacacgcacacucgaguggcauuuaacggaauauucaacggcuugucaagucuggaaguauuaaaaauggccggcaauucuuuucaggagaacuuccucccagauaucuuuacagaacugagaaaucuuaccuuccuggacuugagccagugucagcucgagcaacugucccccacugcuuuuaacucacuaagcucucuccaggugcugaauaugucccauaacaauuucuuuagucuggauacauucccuuauaagugccuuaacagcuugcagguccuggacuacucuuuaaaucacauuaugaccuccaagaaacaggaacuccaacauuuuccaucaagucuggccuuccuuaaccugacgcagaaugauuucgcaugcaccugugagcaccagagcuuucuacaguggaucaaggaccaaaggcagcuccugguggagguugaacggauggagugcgcuacacccucggauaaacaggggaugccgguguugucccugaacauaacuugucagaugaauaagaccauuaucggagucucuguguuaagcguacucguugugucagucguggccguccugguguauaaauucuacuuucaucuuaugcuguuggcggguugcaucaaguauggccguggggaaaacauuuacgacgccuucguuaucuacaguucccaagacgaggauugggugcgcaaugagcucguaaagaaccuggaagagggagucccucccuuucagcuaugucugcacuauagagacuucauuccaggcguggcaauagcugccaacaucauucacgaagguuuucauaaaucuaggaagguuaucguggucgugagccagcacuucauccaaucccgguggugcauuuuugaguacgaaauagcucagacauggcaguuccuuucaagccgagccgggaucauuuuuaucguacuccagaaaguggagaagacucuguugcgccaacagguugagcuguauagauuacucaguaggaauaccuaccuggaaugggaggauucuguccuuggccggcauauuuucuggcgcagacugaggaaagcauugcucgacggaaaguccuggaacccugaaggcacaguggggaccggauguaauuggcaggaggccacuagcaucuga

SEQ ID NO: 9604 - RNA, 2520 nt, Artificial Sequence
  derived and/or modified sequence opt4 from TLR4__Homo_sapiens__AAC80227
augaugagcgccagcagacuggccggcacccugauccccgccauggccuuccugagcugcgugagacccgagagcugggagcccugcguggagguggugcccaacaucaccuaccagugcauggagcugaacuucuacaagauccccgacaaccugcccuucagcaccaagaaccuggaccugagcuucaacccccugagacaccugggcagcuacagcuucuucagcuuccccgagcugcaggugcuggaccugagcagaugcgagauccagaccaucgaggacggcgccuaccagagccugagccaccugagcacccugauccugaccggcaaccccauccagagccuggcccugggcgccuucagcggccugagcagccugcagaagcugguggccguggagaccaaccuggccagccuggagaacuuccccaucggccaccugaagacccugaaggagcugaacguggcccacaaccugauccagagcuucaagcugcccgaguacuucagcaaccugaccaaccuggagcaccuggaccugagcagcaacaagauccagagcaucuacugcaccgaccugagagugcugcaccagaugccccugcugaaccugagccuggaccugagccugaaccccaugaacuucauccagcccggcgccuucaaggagaucagacugcacaagcugacccugagaaacaacuucgacagccugaacgugaugaagaccugcauccagggccuggccggccuggaggugcacagacuggugcugggcgaguucagaaacgagggcaaccuggagaaguucgacaagagcgcccuggagggccugugcaaccugaccaucgaggaguucagacuggccuaccuggacuacuaccuggacgacaucaucgaccuguucaacugccugaccaacgugagcagcuucagccuggugagcgugaccaucgagagagugaaggacuucagcuacaacuucggcuggcagcaccuggagcuggugaacugcaaguucggccaguuccccacccugaagcugaagagccugaagagacugaccuucaccagcaacaagggcggcaacgccuucagcgagguggaccugcccagccuggaguuccuggaccugagcagaaacggccugagcuucaagggcugcugcagccagagcgacuucggcaccaccagccugaaguaccuggaccugagcuucaacggcgugaucaccaugagcagcaacuuccugggccuggagcagcuggagcaccuggacuuccagcacagcaaccugaagcagaugagcgaguucagcguguuccugagccugagaaaccugaucuaccuggacaucagccacacccacaccagaguggccuucaacggcaucuucaacggccugagcagccuggaggugcugaagauggccggcaacagcuuccaggagaacuuccugcccgacaucuucaccgagcugagaaaccugaccuuccuggaccugagccagugccagcuggagcagcugagccccaccgccuucaacagccugagcagccugcaggugcugaacaugagccacaacaacuucuucagccuggacaccuuccccuacaagugccugaacagccugcaggugcuggacuacagccugaaccacaucaugaccagcaagaagcaggagcugcagcacuuccccagcagccuggccuuccugaaccugacccagaacgacuucgccugcaccugcgagcaccagagcuuccugcaguggaucaaggaccagagacagcugcugguggagguggagagaauggagugcgccacccccagcgacaagcagggcaugcccgugcugagccugaacaucaccugccagaugaacaagaccaucaucggcgugagcgugcugagcgugcugguggugagcgugguggccgugcugguguacaaguucuacuuccaccugaugcugcuggccggcugcaucaaguacggcagaggcgagaacaucuacgacgccuucgugaucuacagcagccaggacgaggacugggugagaaacgagcuggugaagaaccuggaggagggcgugccccccuuccagcugugccugcacuacagagacuucauccccggcguggccaucgccgccaacaucauccacgagggcuuccacaagagcagaaaggugaucgugguggugagccagcacuucauccagagcagauggugcaucuucgaguacgagaucgcccagaccuggcaguuccugagcagcagagccggcaucaucuucaucgugcugcagaagguggagaagacccugcugagacagcagguggagcuguacagacugcugagcagaaacaccuaccuggagugggaggacagcgugcugggcagacacaucuucuggagaagacugagaaaggcccugcuggacggcaagagcuggaaccccgagggcaccgugggcaccggcugcaacuggcaggaggccaccagcaucuga

SEQ ID NO: 9605 - RNA, 2520 nt, Artificial Sequence
  derived and/or modified sequence opt5 from TLR4__Homo_sapiens__AAC80227
augaugagcgccuccagacuggcuggcacccucauccccgccauggcguuccugucuugcgugcggccugagagcugggaaccgugugucgagguugugcccaacauuacauaccagugcauggaacuuaauuuuuauaagaucccugacaaccugcccuucuccacgaaaaaucucgaucugucuuuuaacccucuucgccaccuggggagcuacuccuucuuuucuuuccccgagcuccaagugcuggaccugagcagaugugaaauucagaccaucgaggauggagcuuaucagucccucagccaucugucuacacuuauucugaccggcaauccuauccagucccucgcccugggggccuuuagcggacuuucuucccugcaaaagcucgucgcuguggagacaaaccuggccagccuggaaaauuucccgaucggccaccucaaaacccugaaggagcuuaacguugcucauaaucugauucagucuuuuaaacuccccgaauacuucuccaaccugacaaaucuugagcaccuggaccucagcuccaacaagauccagucuauuuauugcaccgaucugcgggugcugcaucagaugccucuccugaaucuuagccuggaccucucccugaaccccaugaauuuuauccaaccuggggccuucaaggagauucgccuucacaaacugacgcucagaaacaacuuugauagccugaaugucaugaagaccuguauccagggacuggcgggccucgaagugcaccggcugguucuuggcgaguuccgcaacgaagggaaucuggagaaauucgacaagucugcccucgaaggacugugcaaccugacaauugaggaguuuagacuugcuuaccucgauuauuaccuggacgauaucaucgaccuguucaauugucucaccaacguguccagcuuuucucuggucagcgugacaauugaacgggugaaagauuucuccuacaauuuuggcuggcagcaucuugagcuggucaacugcaaguucgggcaguuucccacccucaagcugaaaucucugaagcgccuuacguucacaagcaauaaaggaggcaacgccuuuuccgaaguugaccucccgagccuggaguuccuggaccucucuagaaaugggcuguccuuuaagggauguugcagccaaucugauuucggcaccacaucccuuaaauaucuggaccucagcuuuaacggcgugaucaccauguccucuaauuuccuggggcuggaacagcuugagcaccucgauuuccagcauagcaaccugaagcaaauguccgaguuuucuguguuccugagccuccggaaucugauuuaccuugacaucucccacacccacacacgcgucgcuuuuaacggaauuuucaacggccugagcucucucgaagugcugaaaauggccggaaauuccuuucaggagaacuuccugccugauaucuuuacggaacuuagaaaucucaccuuccuggaccugagccagugucagcucgagcaacugucucccacagcguuuaacucccuuagcucucugcagguucucaauaugagccauaacaauuucuuuucccuggauaccuucccuuauaagugccugaacagccuucaggugcuggacuacucucucaaucacaucaugacauccaagaaacaggaacugcaacauuuucccagcucccucgccuuccugaaccuuacccagaaugauuucgcuugcacgugugagcaccagucuuuucugcaguggauuaaggaccaacggcagcuccuggucgagguggaacgcauggagugcgccacacccagcgauaaacaggggaugccuguucugucccuuaacaucaccugucagaugaauaagaccauuaucggcgugucuguccugagcgugcucgucguguccguuguggcuguccugguguauaaauucuacuuucaucucaugcugcuugccgggugcauuaaguauggaagaggcgaaaacaucuacgacgccuucguuaucuacucuagccaagacgaggauugggugcggaaugagcuggucaagaaccucgaagagggcgugccgcccuuucagcugugucugcacuauagagacuucauuccugggguggcuaucgcggccaacauuauccacgaaggauuucauaaaucccgcaagguuauugucguggugagccagcacuucauccaaucucgguggugcauuuuugaguacgaaaucgcucagacauggcaguuccuuuccagcagagccggcaucauuuuuaucguccugcagaaaguggagaagacccuccugcgccaacagguugagcucuaucggcugcuuucuagaaauacauaccuggaaugggaggauuccgugcuggggcgccauauuuucuggcggagacuccgcaaagcccugcuugacggaaagagcuggaaccccgaaggcacggucgggaccggcuguaauuggcaggaggcuacaucuaucuga

SEQ ID NO: 9606 - protein, 858 aa, Artificial Sequence [sequence omitted]

SEQ ID NO: 9607 - RNA, 2577 nt, Artificial Sequence
  TLR5__Homo_sapiens__AAZ17462
augggagaccaccuggaccuucuccuaggaguggugcucauggccgguccuguguuuggaauuccuuccugcuccuuugauggccgaauagccuuuuaucguuucugcaaccucacccaggucccccagguccucaacaccacugagaggcuccugcugagcuucaacuauaucaggacagucacugcuucauccuuccccuuucuggaacagcugcagcugcuggagcucgggagccaguauacccccuugacuauugacaaggaggccuucagaaaccugcccaaccuuagaaucuuggaccugggaaguaguaagauauacuucuugcauccagaugcuuuucagggacuguuccaucuguuugaacuuagacuguauuucuguggucucucugaugcuguauugaaagaugguuauuucagaaauuuaaaggcuuuaacucgcuuggaucuauccaaaaaucagauucguagccuuuaccuucauccuucauuugggaaguugaauuccuuaaaguccauagauuuuuccuccaaccaaauauuccuuguaugugaacaugagcucgagccccuacaagggaaaacgcucuccuuuuuuagccucgcagcuaauagcuuguauagcagagucucaguggacuggggaaaauguaugaacccauucagaaacauggugcuggagauacuagauguuucuggaaauggcuggacaguggacaucacaggaaacuuuagcaaugccaucagcaaaagccaggccuucucuuugauucuugcccaccacaucaugggugccggguuuggcuuccauaacaucaaagauccugaccagaacacauuugcuggccuggccagaaguucagugagacaccuggaucuuucacauggguuugucuucucccugaacucacgagucuuugagacacucaaggauuugaagguucugaaccuugccuacaacaagauaaauaagauugcagaugaagcauuuuacggacuugacaaccuccaaguucucaauuugucauauaaccuucugggggaacuuuacaguucgaauuucuauggacuaccuaagguagccuacauugauuugcaaaagaaucacauugcaauaauucaagaccaaacauucaaauuccuggaaaaauuacagaccuuggaucuccgagacaaugcucuuacaaccauucauuuuauuccaagcauacccgauaucuucuugaguggcaauaaacuagugacuuugccaaagaucaaccuuacagcgaaccucauccacuuaucagaaaacaggcuagaaaaucuagauauucucuacuuucuccuacggguaccucaucuccagauucucauuuuaaaucaaaaucgcuucuccuccuguaguggagaucaaaccccuucagagaaucccagcuuagaacagcuuuuccuuggagaaaauauguugcaacuugccugggaaacugagcucuguugggauguuuuugagggacuuucucaucuucaaguucuguauuugaaucauaacuaucuuaauucccuuccaccaggaguauuuagccaucugacugcauuaaggggacuaagccucaacuccaacaggcugacaguucuuucucacaaugauuuaccugcuaauuuagagauccuggacauauccaggaaccagcuccuagcuccuaauccugauguauuuguaucacuuagugucuuggauauaacucauaacaaguucauuugugaaugugaacuuagcacuuuuaucaauuggcuuaaucacaccaaugucacuauagcugggccuccugcagacauauauuguguguacccugacucgcucucugggguuucccucuucucucuuuccacggaagguugugaugaagaggaagucuuaaagucccuaaaguucucccuuuucuuuguaugcacugucacucugacucuguuccucaugaccauccucacagucacaaaguuccggggcuucuguuuuaucuguuauaagacagcccagagacugguguucaaggaccauccccagggcacagaaccugauauguacaaauaugaugccuauuugugcuucagcagcaaagacuucacaugggugcagaaugcuuugcucaaacaccuggacacucaauacagugaccaaaacagauucaaccugugcuuugaagaaagagacuuugucccaggagaaaaccgcauugccaauauccaggaugccaucuggaacaguagaaagaucguuugucuugugagcagacacuuccuuagagauggcuggugccuugaagccuucaguuaugcccagggcaggugcuuaucugaccuuaacagugcucucaucaugguggugguuggguccuugucccaguaccaguugaugaaacaucaauccaucagaggcuuuguacagaaacagcaguauuugagguggccugaggaucuccaggauguuggcugguuucuucauaaacucucucaacagauacuaaagaaagaaaaagaaaagaagaaagacaauaacauuccguugcaaacuguagcaaccaucuccuaa

SEQ ID NO: 9608 - RNA, 2577 nt, Artificial Sequence
  derived and/or modified sequence opt1 from TLR5__Homo_sapiens__AAZ17462
augggcgaccaccuggaccuccugcugggggugguccucauggccggccccguguucgggaucccgagcugcuccuucgacggccgcaucgccuucuaccgguucugcaaccugacccaggugccccagguccugaacaccacggagcgccuccugcugagcuucaacuacauccggaccgugaccgcguccagcuuccccuuccucgagcagcugcagcugcucgagcuggggucccaguacacgccccugaccaucgacaaggaggccuuccgcaaccucccgaaccugcggauccuggaccucggcagcuccaagaucuacuuccugcaccccgacgccuuccagggccuguuccaccucuucgagcugcgccuguacuucugcgggcucagcgacgccgugcugaaggacggcuacuuccggaaccugaaggcccucacccgccuggaccuguccaagaaccagauccggagccucuaccugcaccccuccuucgggaagcugaacagccucaaguccaucgacuucagcuccaaccagaucuuccuggucugcgagcacgagcuggagccccuccagggcaagacccugagcuucuucucccuggcggccaacagccucuacucccgcgugagcguggacugggggaagugcaugaacccguuccggaacaugguccuggagauccuggacgugagcggcaacggcuggaccguggacaucacggggaacuucuccaacgccaucagcaagucccaggccuucagccucauccuggcgcaccacaucaugggcgccggguucggcuuccacaacaucaaggaccccgaccagaacaccuucgccggccuggcccgcuccagcguccggcaccucgaccugucccacggguucguguucagccugaacucccgcguguucgagacccucaaggaccugaagguccugaaccuggccuacaacaagaucaacaagaucgcggacgaggccuucuacggccucgacaaccuccaggugcugaaccugagcuacaaccugcugggggagcucuacuccagcaacuucuacggccugcccaagguggccuacaucgaccugcagaagaaccacaucgccaucauccaggaccagaccuucaaguuccucgagaagcugcagacgcuggaccuccgggacaacgcccugaccaccauccacuucauccccuccaucccggacaucuuccugagcgggaacaagcucgucacccugcccaagaucaaccugacggcgaaccucauccaccuguccgagaaccgccuggagaaccucgacauccuguacuuccugcuccgggugccccaccuccagauccugauccugaaccagaaccgcuucagcuccugcagcggcgaccagacccccuccgagaacccgagccuggagcagcuguuccucggcgagaacaugcugcagcuggccugggagaccgagcucugcugggacguguucgaggggcugagccaccuccagguccuguaccugaaccacaacuaccugaacucccucccgcccggcguguucagccaccugaccgcccugcgggggcucucccugaacagcaaccgccugacggugcucucccacaacgaccugcccgccaaccuggagauccucgacaucagccggaaccagcugcuggcccccaaccccgacgucuucgugucccucagcguccuggacaucacccacaacaaguucaucugcgagugcgagcuguccaccuucaucaacuggcucaaccacaccaacgugacgaucgcgggcccgcccgccgacaucuacugcguguaccccgacagccuguccggggucagccuguucucccucagcaccgagggcugcgacgaggaggaggugcugaagucccugaaguucagccucuucuucgugugcaccgucacccugacgcuguuccucaugaccauccugaccgugaccaaguuccgcggcuucugcuucaucugcuacaagacggcccagcgccugguguucaaggaccacccccaggggaccgagcccgacauguacaaguacgacgccuaccucugcuucuccagcaaggacuucaccuggguccagaacgcccugcugaagcaccucgacacccaguacagcgaccagaaccgguucaaccugugcuucgaggagcgcgacuucgugcccggcgagaaccggaucgcgaacauccaggacgccaucuggaacucccgcaagaucgugugccuggucagccggcacuuccuccgcgacggguggugccuggaggccuucuccuacgcccagggccggugccugagcgaccucaacuccgcgcugaucauggugguggucgggagccugucccaguaccagcucaugaagcaccagagcauccgcggcuucgugcagaagcagcaguaccugcgguggccggaggaccugcaggacgugggcugguuccuccacaagcugucccagcagauccugaagaaggagaaggagaagaagaaggacaacaacaucccccuccagacggucgccaccaucagcuga

SEQ ID NO: 9609 - RNA, 2577 nt, Artificial Sequence
  derived and/or modified sequence opt2 from TLR5__Homo_sapiens__AAZ17462
augggcgaccaccucgaccuccuccucggcgucguccucauggccggccccgucuucggcauccccuccugcuccuucgacggccgcaucgccuucuaccgcuucugcaaccucacccaggucccccagguccucaacaccaccgagcgccuccuccucuccuucaacuacauccgcaccgucaccgccuccuccuuccccuuccucgagcagcuccagcuccucgagcucggcucccaguacaccccccucaccaucgacaaggaggccuuccgcaaccuccccaaccuccgcauccucgaccucggcuccuccaagaucuacuuccuccaccccgacgccuuccagggccucuuccaccucuucgagcuccgccucuacuucugcggccucuccgacgccguccucaaggacggcuacuuccgcaaccucaaggcccucacccgccucgaccucuccaagaaccagauccgcucccucuaccuccaccccuccuucggcaagcucaacucccucaaguccaucgacuucuccuccaaccagaucuuccucgucugcgagcacgagcucgagccccuccagggcaagacccucuccuucuucucccucgccgccaacucccucuacucccgcgucuccgucgacuggggcaagugcaugaaccccuuccgcaacaugguccucgagauccucgacgucuccggcaacggcuggaccgucgacaucaccggcaacuucuccaacgccaucuccaagucccaggccuucucccucauccucgcccaccacaucaugggcgccggcuucggcuuccacaacaucaaggaccccgaccagaacaccuucgccggccucgcccgcuccuccguccgccaccucgaccucucccacggcuucgucuucucccucaacucccgcgucuucgagacccucaaggaccucaagguccucaaccucgccuacaacaagaucaacaagaucgccgacgaggccuucuacggccucgacaaccuccagguccucaaccucuccuacaaccuccucggcgagcucuacuccuccaacuucuacggccuccccaaggucgccuacaucgaccuccagaagaaccacaucgccaucauccaggaccagaccuucaaguuccucgagaagcuccagacccucgaccuccgcgacaacgcccucaccaccauccacuucauccccuccauccccgacaucuuccucuccggcaacaagcucgucacccuccccaagaucaaccucaccgccaaccucauccaccucuccgagaaccgccucgagaaccucgacauccucuacuuccuccuccgcgucccccaccuccagauccucauccucaaccagaaccgcuucuccuccugcuccggcgaccagacccccuccgagaaccccucccucgagcagcucuuccucggcgagaacaugcuccagcucgccugggagaccgagcucugcugggacgucuucgagggccucucccaccuccagguccucuaccucaaccacaacuaccucaacucccucccccccggcgucuucucccaccucaccgcccuccgcggccucucccucaacuccaaccgccucaccguccucucccacaacgaccuccccgccaaccucgagauccucgacaucucccgcaaccagcuccucgcccccaaccccgacgucuucgucucccucuccguccucgacaucacccacaacaaguucaucugcgagugcgagcucuccaccuucaucaacuggcucaaccacaccaacgucaccaucgccggcccccccgccgacaucuacugcgucuaccccgacucccucuccggcgucucccucuucucccucuccaccgagggcugcgacgaggaggagguccucaagucccucaaguucucccucuucuucgucugcaccgucacccucacccucuuccucaugaccauccucaccgucaccaaguuccgcggcuucugcuucaucugcuacaagaccgcccagcgccucgucuucaaggaccacccccagggcaccgagcccgacauguacaaguacgacgccuaccucugcuucuccuccaaggacuucaccuggguccagaacgcccuccucaagcaccucgacacccaguacuccgaccagaaccgcuucaaccucugcuucgaggagcgcgacuucguccccggcgagaaccgcaucgccaacauccaggacgccaucuggaacucccgcaagaucgucugccucgucucccgccacuuccuccgcgacggcuggugccucgaggccuucuccuacgcccagggccgcugccucuccgaccucaacuccgcccucaucauggucgucgucggcucccucucccaguaccagcucaugaagcaccaguccauccgcggcuucguccagaagcagcaguaccuccgcuggcccgaggaccuccaggacgucggcugguuccuccacaagcucucccagcagauccucaagaaggagaaggagaagaagaaggacaacaacaucccccuccagaccgucgccaccaucuccuga

SEQ ID NO: 9610 - RNA, 2577 nt, Artificial Sequence
  derived and/or modified sequence opt3 from TLR5__Homo_sapiens__AAZ17462
augggcgaccaccuggaucuccuucuggggguggucuugauggccggacccguuuucgguaucccuagcugcuccuuugacggcagaauugcuuucuacagguuuuguaacuuaacccaggugccacaaguacugaauacaacugagcggcuacuccugucuuucaacuauauacgcacggugaccgcaucaaguuuuccguuccuugaacagcugcaguugcucgagcuggggagccaguacacaccccugacuaucgauaaggaagccuuucgaaaucucccuaacuuacguauucuggaccuuggauccucuaaaaucuauuucuugcauccagaugcguuucaaggccuguuccaccuauuugagcucagacuguacuucugcggucuuucggacgcuguccugaaggauggguauuuuaggaauuugaaagcccucacccggcuggacuuaucaaagaaccagauucgcagccuguaccuccaucccaguuucggaaaacuuaauucccugaagucuaucgauuucagcuccaaccagauauuuuuggugugugaacacgagcuagagccucugcagggcaagacacucucauucuuuagucuggcagccaauagccuuuauucuagaguuuccguggacuggggcaaaugcaugaacccauucaggaauaugguccuggaaaucuuggaugugucagggaacggauggaccguagacauuacugguaauuuuagcaacgcuaucaguaagucucaagcauucucccucauucuggcccaucacaucaugggcgcuggguuuggauuccacaauauaaaagaucccgaccagaacacauuugccggcuuagcgcggagcucgguucgccaucuggaccuaucucacgguuucguguuuucccucaacucacgagucuucgagacccugaaggaucuuaaaguguugaaucuggcauacaacaagauuaauaagaucgccgacgaggcuuuuuacgggcucgauaaccugcaagugcuuaaucugaguuauaacuugcucggagaacuguacagcuccaauuucuauggcuuaccuaaagucgccuacauugaccugcagaagaaccauaucgcaaucauucaggaucagacguucaaauuucuagagaagcuccagacucuggaccuuagagauaaugcuuugaccacaauacacuucaucccaucuauuccggacaucuuucugagcggcaacaaacucguuacucugcccaagauaaauuuaaccgccaaccugauucaccuuucagaaaauagguuggagaaccucgauauccuguauuuccuacugcgggugccucaucuccaaauccugauucuuaaucagaaccguuuuaguuccuguagcggggaccagacaccaucugaaaaccccucauuggagcagcuguucuuaggagaaaauaugcuccaacuggcgugggagaccgagcuuugcugggauguauuugaaggucugagucaccuccagguguuguaccugaaccauaauuaucuaaacagccugccuccaggcgucuucucccaccucacggcccugcgcgggcuuucuuugaacucgaauagacugacuguguuaagccauaaugaccuccccgcaaaccuggagauccuugacauuuccaggaaucagcugcuagcuccgaacccugauguuuuugugucacucaguguccuggacauaacacacaauaaauucaucugugaaugcgaguugucuaccuuuauuaacuggcugaaucacacuaacgugacaaucgccggacccccagcugauaucuacuguguauacccugacagcuuauccggcguuucacucuucagccugucuaccgaagguugcgaugaggaggaagugcuuaagucccugaaguuuaguuuguucuucgucuguacggugacccucacacuguuucuaaugacuauucugaccgucacaaaauuccggggguuuugcuucauaugcuauaagacugcccagcgacuuguguuuaaagaccauccccaaggcaccgagccagauauguacaaguaugacgcauaccucuguuucagcucuaaagauuuuacauggguucagaaugcccuguugaagcaccuggacacccaguauuccgaucagaaccgcuucaacuuaugcuuugaagagagagacuucgugcccggagaaaauaggaucgcuaacauucaagaugcgaucuggaauagucggaagauuguaugucucgucucacgccauuuucugagagacggcuggugccuugaggcauucagcuacgcccaggggaggugucugucggacuugaacuccgcucucaucauggugguugugggaucucugagccaguaucagcuaaugaaacaccaaucaauacgugguuucguccagaagcagcaauaccugcgguggccugaggaucuucaggacgugggcugguuucuccacaaacugagucagcagaucuugaagaaagaaaaggagaagaaaaaggauaauaacauuccauuacaaacuguagccacgaucuccuga

SEQ ID NO: 9611 - RNA, 2577 nt, Artificial Sequence
  derived and/or modified sequence opt4 from TLR5__Homo_sapiens__AAZ17462
augggcgaccaccuggaccugcugcugggcguggugcugauggccggccccguguucggcauccccagcugcagcuucgacggcagaaucgccuucuacagauucugcaaccugacccaggugccccaggugcugaacaccaccgagagacugcugcugagcuucaacuacaucagaaccgugaccgccagcagcuuccccuuccuggagcagcugcagcugcuggagcugggcagccaguacaccccccugaccaucgacaaggaggccuucagaaaccugcccaaccugagaauccuggaccugggcagcagcaagaucuacuuccugcaccccgacgccuuccagggccuguuccaccuguucgagcugagacuguacuucugcggccugagcgacgccgugcugaaggacggcuacuucagaaaccugaaggcccugaccagacuggaccugagcaagaaccagaucagaagccuguaccugcaccccagcuucggcaagcugaacagccugaagagcaucgacuucagcagcaaccagaucuuccuggugugcgagcacgagcuggagccccugcagggcaagacccugagcuucuucagccuggccgccaacagccuguacagcagagugagcguggacuggggcaagugcaugaaccccuucagaaacauggugcuggagauccuggacgugagcggcaacggcuggaccguggacaucaccggcaacuucagcaacgccaucagcaagagccaggccuucagccugauccuggcccaccacaucaugggcgccggcuucggcuuccacaacaucaaggaccccgaccagaacaccuucgccggccuggccagaagcagcgugagacaccuggaccugagccacggcuucguguucagccugaacagcagaguguucgagacccugaaggaccugaaggugcugaaccuggccuacaacaagaucaacaagaucgccgacgaggccuucuacggccuggacaaccugcaggugcugaaccugagcuacaaccugcugggcgagcuguacagcagcaacuucuacggccugcccaagguggccuacaucgaccugcagaagaaccacaucgccaucauccaggaccagaccuucaaguuccuggagaagcugcagacccuggaccugagagacaacgcccugaccaccauccacuucauccccagcauccccgacaucuuccugagcggcaacaagcuggugacccugcccaagaucaaccugaccgccaaccugauccaccugagcgagaacagacuggagaaccuggacauccuguacuuccugcugagagugccccaccugcagauccugauccugaaccagaacagauucagcagcugcagcggcgaccagacccccagcgagaaccccagccuggagcagcuguuccugggcgagaacaugcugcagcuggccugggagaccgagcugugcugggacguguucgagggccugagccaccugcaggugcuguaccugaaccacaacuaccugaacagccugccccccggcguguucagccaccugaccgcccugagaggccugagccugaacagcaacagacugaccgugcugagccacaacgaccugcccgccaaccuggagauccuggacaucagcagaaaccagcugcuggcccccaaccccgacguguucgugagccugagcgugcuggacaucacccacaacaaguucaucugcgagugcgagcugagcaccuucaucaacuggcugaaccacaccaacgugaccaucgccggcccccccgccgacaucuacugcguguaccccgacagccugagcggcgugagccuguucagccugagcaccgagggcugcgacgaggaggaggugcugaagagccugaaguucagccuguucuucgugugcaccgugacccugacccuguuccugaugaccauccugaccgugaccaaguucagaggcuucugcuucaucugcuacaagaccgcccagagacugguguucaaggaccacccccagggcaccgagcccgacauguacaaguacgacgccuaccugugcuucagcagcaaggacuucaccugggugcagaacgcccugcugaagcaccuggacacccaguacagcgaccagaacagauucaaccugugcuucgaggagagagacuucgugcccggcgagaacagaaucgccaacauccaggacgccaucuggaacagcagaaagaucgugugccuggugagcagacacuuccugagagacggcuggugccuggaggccuucagcuacgcccagggcagaugccugagcgaccugaacagcgcccugaucauggugguggugggcagccugagccaguaccagcugaugaagcaccagagcaucagaggcuucgugcagaagcagcaguaccugagauggcccgaggaccugcaggacgugggcugguuccugcacaagcugagccagcagauccugaagaaggagaaggagaagaagaaggacaacaacaucccccugcagaccguggccaccaucagcuga

SEQ ID NO: 9612 - RNA, 2577 nt, Artificial Sequence
  derived and/or modified sequence opt5 from TLR5__Homo_sapiens__AAZ17462
augggcgaccaccuggaucuccugcuuggggugguccugauggccggacccguuuucggcaucccuagcugcuccuuugacgggagaauugcuuucuaccgguuuuguaaccucacccaggugccgcaagugcugaauacaacggagcgccuucugcucucuuucaacuauaucagaaccgucacagccagcuccuuucccuuccuggaacagcugcagcuccuggagcuuggaucucaguacaccccucugacaauugauaaggaagcguuucggaaucuccccaaccugcgcauccuugaccugggcagcuccaaaauuuauuuccuccauccugaugcuuuucaagggcuguuccaccuguuugagcucagacuguacuucugcggacuuucugacgccgugcugaaggauggcuauuuucggaaucucaaagcccugacccgccuugaccugagcaagaaccagaucagaucccucuaccugcaucccagcuucggcaaacucaauucucucaaguccaucgauuucagcucuaaccagauuuuucugguuugugaacacgagcuugagccucugcaggggaagacacucuccuucuuuagccuggcugccaauucucuuuauucccgggugagcgucgacuggggaaaaugcaugaacccguuccgcaauauggugcuggaaauccucgauguuuccggcaacggguggaccguggacauuacgggaaauuuuucuaacgcuaucagcaagucccaagccuucagccugauucuggcgcaucacaucaugggcgccggguuuggauuccacaauauuaaagaucccgaccagaacaccuuugcuggccucgccagaucuuccguccggcaucuggaccuuagccacggcuucguguuuucucugaacagccgcguguucgagacacucaaggaucugaaaguccugaaucuugcuuacaacaagaucaauaagaucgccgacgaagcguuuuacgggcucgauaaccugcagguucugaaucucuccuauaaccugcuuggagagcuguacucuagcaauuucuauggccucccuaaaguggccuacauugaccugcagaagaaccauaucgcuauuauccaagaucagaccuucaaauuucuggagaagcugcagacacucgaccugagagauaaugcccugaccacgauucacuucauccccuccaucccugacauuuuucucagcgggaacaaacuggugacacuucccaagaucaaucugaccgcuaaccucauucaccugucugaaaaucggcuggagaaccuugauauccucuauuuccugcugcgcgucccgcaucuccaaauucugauccuuaaucagaacagauuuuccagcuguucuggagaccagacaccuuccgaaaaccccagccuggagcagcuguuccugggcgaaaauaugcugcaacuugccugggagaccgagcucugcugggauguguuugaagggcugucccaccuucagguucucuaccugaaccauaauuaucuuaacucucugccucccggaguguucagccaccucaccgcccugcggggccugucccuuaauucuaacagacugacaguccucagccauaaugaccugcccgcuaaccucgagauccuggacauuucccgcaaucagcuucuggcgccuaacccggauguguuuguuagccucucugugcuggacaucacgcacaauaaauucauuugugaaugcgagcuguccaccuuuaucaacuggcuuaaucacacaaacgucaccauugccgggcccccugcugauaucuacuguguguaccccgacagccugucuggcgucucccucuucagccugucuacagaaggaugcgaugaggaggaagugcucaagagccugaaguuuucccuuuucuucguuuguaccgugacgcugacacucuuucugaugaccauucugaccgucacaaaauuccggggcuuuugcuucaucugcuauaagaccgcccagagacuuguguuuaaagaccauccucaagggacagagcccgauauguacaaguaugacgccuaccuguguuucagcucuaaagauuuuacguggguucagaaugcucuccugaagcaccucgacacccaguauuccgaucagaaccgcuucaaccugugcuuugaggaacgggacuucgugccgggagaaaauagaaucgccaacauucaagaugcgaucuggaauagccgcaagauugucugucuugugucccggcauuuucugagagacggcuggugccuggaggcuuucucuuacgcccaggggcgcugucucagcgaccugaacuccgcccuuaucauggugguugucggcucucugagccaguaucagcucaugaaacaccaauccauucggggauucgugcagaagcagcaauaccugagauggccugaggaucuccaggacgugggcugguuucugcacaaacuuucucagcagauccugaagaaagaaaaggagaagaaaaaggauaauaacaucccccugcaaacagucgcuaccauuagcuga

SEQ ID NO: 9613 - protein, 858 aa, Artificial Sequence [sequence omitted]

SEQ ID NO: 9614 - RNA, 2577 nt, Artificial Sequence
  TLR5__Homo_sapiens__AAZ17465
augggagaccaccuggaccuucuccuaggaguggugcucauggccgguccuguguuuggaauuccuuccugcuccuuugauggccgaauagccuuuuaucguuucugcaaccucacccaggucccccagguccucaacaccacugagaggcuccugcugagcuucaacuauaucaggacagucacugcuucauccuuccccuuucuggaacagcugcagcugcuggagcucgggagccaguauauccccuugacuauugacaaggaggccuucagaaaccugcccaaccuuagaaucuuggaccugggaaguaguaagauauacuucuugcauccagaugcuuuucagggacuguuccaucuguuugaacuuagacuguauuucuguggucucucugaugcuguauugaaagaugguuauuucagaaauuuaaaggcuuuaacucgcuuggaucuauccaaaaaucagauucguagccuuuaccuucauccuucauuugggaaguugaauuccuuaaaguccauagauuuuuccuccaaccaaauauuccuuguaugugaacaugagcucgagccccuacaagggaaaacgcucuccuuuuuuagccucgcagcuaauagcuuguauagcagagucucaguggacuggggaaaauguaugaacccauucagaaacauggugcuggagauacuagauguuucuggaaauggcuggacaguggacaucacaggaaacuuuagcaaugccaucagcaaaagccaggccuucucuuugauucuugcccaccacaucaugggugccggguuuggcuuccauaacaucaaagauccugaccagaacacauuugcuggccuggccagaaguucagugagacaccuggaucuuucacauggguuugucuucucccugaacucacgagucuuugagacacucaaggauuugaagguucugaaccuugccuacaacaagauaaauaagauugcagaugaagcauuuuacggacuugacaaccuccaaguucucaauuugucauauaaccuucugggggaacuuuacaguucgaauuucuauggacuaccuaagguagccuacauugauuugcaaaagaaucacauugcaauaauucaagaccaaacauucaaauuccuggaaaaauuacagaccuuggaucuccgagacaaugcucuuacaaccauucauuuuauuccaagcauacccgauaucuucuugaguggcaauaaacuagugacuuugccaaagaucaaccuuacagcgaaccucauccacuuaucagaaaacaggcuagaaaaucuagauauucucuacuuucuccuacggguaccucaucuccagauucucauuuuaaaucaaaaucgcuucuccuccuguaguggagaucaaaccccuucagagaaucccagcuuagaacagcuuuuccuuggagaaaauauguugcaacuugccugggaaacugagcucuguugggauguuuuugagggacuuucucaucuucaaguucuguauuugaaucauaacuaucuuaauucccuuccaccaggaguauuuagccaucugacugcauuaaggggacuaagccucaacuccaacaggcugacaguucuuucucacaaugauuuaccugcuaauuuagagauccuggacauauccaggaaccagcuccuagcuccuaauccugauguauuuguaucacuuagugucuuggauauaacucauaacaaguucauuugugaaugugaacuuagcacuuuuaucaauuggcuuaaucacaccaaugucacuauagcugggccuccugcagacauauauuguguguacccugacucguucucugggguuucccucuucucucuuuccacggaagguugugaugaagaggaagucuuaaagucccuaaaguucucccuuuucuuuguaugcacugucacucugacucuguuccucaugaccauccucacagucacaaaguuccggggcuucuguuuuaucuguuauaagacagcccagagacugguguucaaggaccauccccagggcacagaaccugauauguacaaauaugaugccuauuugugcuucagcagcaaagacuucacaugggugcagaaugcuuugcucaaacaccuggacacucaauacagugaccaaaacagauucaaccugugcuuugaagaaagagacuuugucccaggagaaaaccgcauugccaauauccaggaugccaucuggaacaguagaaagaucguuugucuugugagcagacacuuccuuagagauggcuggugccuugaagccuucaguuaugcccagggcaggugcuuaucugaccuuaacagugcucucaucaugguggugguuggguccuugucccaguaccaguugaugaaacaucaauccaucagaggcuuuguacagaaacagcaguauuugagguggccugaggaucuccaggauguuggcugguuucuucauaaacucucucaacagauacuaaagaaagaaaaagaaaagaagaaagacaauaacauuccguugcaaacuguagcaaccaucuccuaa

SEQ ID NO: 9615 - RNA, 2577 nt, Artificial Sequence
  derived and/or modified sequence opt1 from TLR5__Homo_sapiens__AAZ17465
augggcgaccaccuggaccuccugcugggggugguccucauggccggccccguguucgggaucccgagcugcuccuucgacggccgcaucgccuucuaccgguucugcaaccugacccaggugccccagguccugaacaccacggagcgccuccugcugagcuucaacuacauccggaccgugaccgcguccagcuuccccuuccucgagcagcugcagcugcucgagcuggggucccaguacaucccccugaccaucgacaaggaggccuuccgcaaccucccgaaccugcggauccuggaccucggcagcuccaagaucuacuuccugcaccccgacgccuuccagggccuguuccaccucuucgagcugcgccuguacuucugcgggcucagcgacgccgugcugaaggacggcuacuuccggaaccugaaggcccucacgcgccuggaccuguccaagaaccagauccggagccucuaccugcaccccuccuucgggaagcugaacagccucaaguccaucgacuucagcuccaaccagaucuuccuggucugcgagcacgagcuggagccccuccagggcaagacccugagcuucuucucccuggcggccaacagccucuacucccgcgugagcguggacugggggaagugcaugaacccguuccggaacaugguccuggagauccuggacgugagcggcaacggcuggaccguggacaucaccgggaacuucuccaacgccaucagcaagucccaggccuucagccucauccuggcgcaccacaucaugggcgccggguucggcuuccacaacaucaaggaccccgaccagaacacguucgccggccuggcccgcuccagcguccggcaccucgaccugucccacggguucguguucagccugaacucccgcguguucgagacccucaaggaccugaagguccugaaccuggccuacaacaagaucaacaagaucgcggacgaggccuucuacggccucgacaaccuccaggugcugaaccugagcuacaaccugcugggggagcucuacuccagcaacuucuacggccugcccaagguggccuacaucgaccugcagaagaaccacaucgccaucauccaggaccagaccuucaaguuccucgagaagcugcagacccuggaccuccgggacaacgcccugacgaccauccacuucauccccuccaucccggacaucuuccugagcgggaacaagcucgucacccugcccaagaucaaccugaccgcgaaccucauccaccuguccgagaaccgccuggagaaccucgacauccuguacuuccugcuccgggugccccaccuccagauccugauccugaaccagaaccgcuucagcuccugcagcggcgaccagacgcccuccgagaacccgagccuggagcagcuguuccucggcgagaacaugcugcagcuggccugggagaccgagcucugcugggacguguucgaggggcugagccaccuccagguccuguaccugaaccacaacuaccugaacucccucccgcccggcguguucagccaccugaccgcccugcgggggcucucccugaacagcaaccgccugaccgugcucucccacaacgaccugcccgccaaccuggagauccucgacaucagccggaaccagcugcuggcccccaaccccgacgucuucgugucccucagcguccuggacaucacgcacaacaaguucaucugcgagugcgagcuguccaccuucaucaacuggcucaaccacaccaacgugaccaucgcgggcccgcccgccgacaucuacugcguguaccccgacagcuucuccggggucagccuguucucccugagcacggagggcugcgacgaggaggaggugcucaagucccugaaguucagccuguucuucgugugcaccgucacccucacccuguuccugaugacgauccucaccgugaccaaguuccgcggcuucugcuucaucugcuacaagaccgcccagcgccugguguucaaggaccacccccaggggacggagcccgacauguacaaguacgacgccuaccugugcuucuccagcaaggacuucaccuggguccagaacgcccuccugaagcaccuggacacccaguacagcgaccagaaccgguucaaccucugcuucgaggagcgcgacuucgugcccggcgagaaccggaucgcgaacauccaggacgccaucuggaacucccgcaagaucgugugccuggucagccggcacuuccugcgcgacggguggugccucgaggccuucuccuacgcccagggccggugccugagcgaccugaacuccgcgcucaucauggugguggucgggagccugucccaguaccagcugaugaagcaccagagcauccgcggcuucgugcagaagcagcaguaccuccgguggccggaggaccugcaggacgugggcugguuccugcacaagcucucccagcagauccugaagaaggagaaggagaagaagaaggacaacaacaucccccugcagaccgucgccacgaucagcuga

SEQ ID NO: 9616 - RNA, 2577 nt, Artificial Sequence
  derived and/or modified sequence opt2 from TLR5__Homo_sapiens__AAZ17465
augggcgaccaccucgaccuccuccucggcgucguccucauggccggccccgucuucggcauccccuccugcuccuucgacggccgcaucgccuucuaccgcuucugcaaccucacccaggucccccagguccucaacaccaccgagcgccuccuccucuccuucaacuacauccgcaccgucaccgccuccuccuuccccuuccucgagcagcuccagcuccucgagcucggcucccaguacaucccccucaccaucgacaaggaggccuuccgcaaccuccccaaccuccgcauccucgaccucggcuccuccaagaucuacuuccuccaccccgacgccuuccagggccucuuccaccucuucgagcuccgccucuacuucugcggccucuccgacgccguccucaaggacggcuacuuccgcaaccucaaggcccucacccgccucgaccucuccaagaaccagauccgcucccucuaccuccaccccuccuucggcaagcucaacucccucaaguccaucgacuucuccuccaaccagaucuuccucgucugcgagcacgagcucgagccccuccagggcaagacccucuccuucuucucccucgccgccaacucccucuacucccgcgucuccgucgacuggggcaagugcaugaaccccuuccgcaacaugguccucgagauccucgacgucuccggcaacggcuggaccgucgacaucaccggcaacuucuccaacgccaucuccaagucccaggccuucucccucauccucgcccaccacaucaugggcgccggcuucggcuuccacaacaucaaggaccccgaccagaacaccuucgccggccucgcccgcuccuccguccgccaccucgaccucucccacggcuucgucuucucccucaacucccgcgucuucgagacccucaaggaccucaagguccucaaccucgccuacaacaagaucaacaagaucgccgacgaggccuucuacggccucgacaaccuccagguccucaaccucuccuacaaccuccucggcgagcucuacuccuccaacuucuacggccuccccaaggucgccuacaucgaccuccagaagaaccacaucgccaucauccaggaccagaccuucaaguuccucgagaagcuccagacccucgaccuccgcgacaacgcccucaccaccauccacuucauccccuccauccccgacaucuuccucuccggcaacaagcucgucacccuccccaagaucaaccucaccgccaaccucauccaccucuccgagaaccgccucgagaaccucgacauccucuacuuccuccuccgcgucccccaccuccagauccucauccucaaccagaaccgcuucuccuccugcuccggcgaccagacccccuccgagaaccccucccucgagcagcucuuccucggcgagaacaugcuccagcucgccugggagaccgagcucugcugggacgucuucgagggccucucccaccuccagguccucuaccucaaccacaacuaccucaacucccucccccccggcgucuucucccaccucaccgcccuccgcggccucucccucaacuccaaccgccucaccguccucucccacaacgaccuccccgccaaccucgagauccucgacaucucccgcaaccagcuccucgcccccaaccccgacgucuucgucucccucuccguccucgacaucacccacaacaaguucaucugcgagugcgagcucuccaccuucaucaacuggcucaaccacaccaacgucaccaucgccggcccccccgccgacaucuacugcgucuaccccgacuccuucuccggcgucucccucuucucccucuccaccgagggcugcgacgaggaggagguccucaagucccucaaguucucccucuucuucgucugcaccgucacccucacccucuuccucaugaccauccucaccgucaccaaguuccgcggcuucugcuucaucugcuacaagaccgcccagcgccucgucuucaaggaccacccccagggcaccgagcccgacauguacaaguacgacgccuaccucugcuucuccuccaaggacuucaccuggguccagaacgcccuccucaagcaccucgacacccaguacuccgaccagaaccgcuucaaccucugcuucgaggagcgcgacuucguccccggcgagaaccgcaucgccaacauccaggacgccaucuggaacucccgcaagaucgucugccucgucucccgccacuuccuccgcgacggcuggugccucgaggccuucuccuacgcccagggccgcugccucuccgaccucaacuccgcccucaucauggucgucgucggcucccucucccaguaccagcucaugaagcaccaguccauccgcggcuucguccagaagcagcaguaccuccgcuggcccgaggaccuccaggacgucggcugguuccuccacaagcucucccagcagauccucaagaaggagaaggagaagaagaaggacaacaacaucccccuccagaccgucgccaccaucuccuga

SEQ ID NO: 9617 - RNA, 2577 nt, Artificial Sequence
  derived and/or modified sequence opt3 from TLR5__Homo_sapiens__AAZ17465
augggcgaccaccuggaucuccuucuggggguggucuugauggccggacccguuuucgguaucccuagcugcuccuuugacggcagaauugcuuucuacagguuuuguaacuuaacccaggugccacaaguacugaauacaacugagcggcuacuccugucuuucaacuauauacgcacggugaccgcaucaaguuuuccguuccuugaacagcugcaguugcucgagcuggggagccaguacaucccccugacaauugauaaggaagccuuucgaaaucucccuaacuuacguauccuggaccuuggauccucuaaaauuuauuucuugcauccagaugcguuucaaggccuguuccaccuauuugagcucagacuguacuucugcggucuuucggacgcuguccugaaggauggguauuuuaggaauuugaaagcccucacucggcuggacuuaucaaagaaccagauccgcagccuguaccuccaucccaguuucggaaaacuuaauucccugaagucuauagauuucagcuccaaccagaucuuuuuggugugugaacacgagcuagagccucugcagggcaagacccucucauucuuuagucuggcagccaauagccuuuauucuagaguuuccguggacuggggcaaaugcaugaacccauucaggaauaugguccuggaaauuuuggaugugucagggaacggauggacaguagacaucaccgguaauuuuagcaacgcuauuaguaagucucaagcauucucccucauccuggcccaucacauaaugggcgcuggguuuggauuccacaauauuaaagaucccgaccagaacacuuuugccggcuuagcgcggagcucgguucgccaucuggaccuaucucacgguuucguguuuucccucaacucacgagucuucgagacacugaaggaucuuaaaguguugaaucuggcauacaacaagaucaauaagauugccgacgaggcuuuuuacgggcucgauaaccugcaagugcuuaaucugaguuauaacuugcucggagaacuguacagcuccaauuucuauggcuuaccuaaagucgccuacaucgaccugcagaagaaccauaucgcaauuauacaggaucagaccuucaaauuucuagagaagcuccagacgcuggaccuuagagauaaugcuuugacuaccauccacuucauuccaucuaucccggacauauuucugagcggcaacaaacucguuacacugcccaagauuaauuuaacugccaaccugauccaccuuucagaaaauagguuggagaaccucgauauccuguauuuccuacugcgggugccucaucuccaaauucugauccuuaaucagaaccguuuuaguuccuguagcggggaccagaccccaucugaaaaccccucauuggagcagcuguucuuaggagaaaauaugcuccaacuggcgugggagacagagcuuugcugggauguauuugaaggucugagucaccuccagguguuguaccugaaccauaauuaucuaaacagccugccuccaggcgucuucucccaccucaccgcccugcgcgggcuuucuuugaacucgaauagacugacgguguuaagccauaaugaccuccccgcaaaccuggagauucuugacauauccaggaaucagcugcuagcuccgaacccugauguuuuugugucacucaguguccuggacaucacucacaauaaauucauuugugaaugcgaguugucuacauuuaucaacuggcugaaucacaccaacgugacuaucgccggacccccagcugauauuuacuguguauacccugacagcuucuccggcguuucauuauuuagccucucuacagaagguugcgaugaggaggaagugcugaagucccuuaaguucagucuguucuuugucuguaccgugacguugacccucuuccugaugacaauacuaacugucaccaaauuucggggguucugcuuuaucugcuauaagacagcccagcgacugguguucaaagaccauccccaaggcacugagccagauauguacaaguaugacgcauaccuuuguuuuagcucuaaagauuucaccuggguucagaaugcccuccugaagcacuuggacacacaguauuccgaucagaaccgcuuuaaccugugcuucgaagagagagacuuugugcccggagaaaauaggauugcuaacauccaagaugcgauuuggaauagucggaagaucguauguuuagucucacgccauuuccucagagacggcuggugccuggaggcauucagcuacgcccaggggaggugucuuucggaccugaacuccgcuuugauaauggugguugugggaucucucagccaguaucagcugaugaaacaccaaucaauccgugguuuuguccagaagcagcaauaccuacgguggccugaggaucugcaggacgugggcugguuccuucacaaacucagucagcagauucugaagaaagaaaaggagaagaaaaaggauaauaacaucccauugcaaaccguagccacuauuuccuga

SEQ ID NO: 9618 - RNA, 2577 nt, Artificial Sequence
  derived and/or modified sequence opt4 from TLR5__Homo_sapiens__AAZ17465
augggcgaccaccuggaccugcugcugggcguggugcugauggccggccccguguucggcauccccagcugcagcuucgacggcagaaucgccuucuacagauucugcaaccugacccaggugccccaggugcugaacaccaccgagagacugcugcugagcuucaacuacaucagaaccgugaccgccagcagcuuccccuuccuggagcagcugcagcugcuggagcugggcagccaguacaucccccugaccaucgacaaggaggccuucagaaaccugcccaaccugagaauccuggaccugggcagcagcaagaucuacuuccugcaccccgacgccuuccagggccuguuccaccuguucgagcugagacuguacuucugcggccugagcgacgccgugcugaaggacggcuacuucagaaaccugaaggcccugaccagacuggaccugagcaagaaccagaucagaagccuguaccugcaccccagcuucggcaagcugaacagccugaagagcaucgacuucagcagcaaccagaucuuccuggugugcgagcacgagcuggagccccugcagggcaagacccugagcuucuucagccuggccgccaacagccuguacagcagagugagcguggacuggggcaagugcaugaaccccuucagaaacauggugcuggagauccuggacgugagcggcaacggcuggaccguggacaucaccggcaacuucagcaacgccaucagcaagagccaggccuucagccugauccuggcccaccacaucaugggcgccggcuucggcuuccacaacaucaaggaccccgaccagaacaccuucgccggccuggccagaagcagcgugagacaccuggaccugagccacggcuucguguucagccugaacagcagaguguucgagacccugaaggaccugaaggugcugaaccuggccuacaacaagaucaacaagaucgccgacgaggccuucuacggccuggacaaccugcaggugcugaaccugagcuacaaccugcugggcgagcuguacagcagcaacuucuacggccugcccaagguggccuacaucgaccugcagaagaaccacaucgccaucauccaggaccagaccuucaaguuccuggagaagcugcagacccuggaccugagagacaacgcccugaccaccauccacuucauccccagcauccccgacaucuuccugagcggcaacaagcuggugacccugcccaagaucaaccugaccgccaaccugauccaccugagcgagaacagacuggagaaccuggacauccuguacuuccugcugagagugccccaccugcagauccugauccugaaccagaacagauucagcagcugcagcggcgaccagacccccagcgagaaccccagccuggagcagcuguuccugggcgagaacaugcugcagcuggccugggagaccgagcugugcugggacguguucgagggccugagccaccugcaggugcuguaccugaaccacaacuaccugaacagccugccccccggcguguucagccaccugaccgcccugagaggccugagccugaacagcaacagacugaccgugcugagccacaacgaccugcccgccaaccuggagauccuggacaucagcagaaaccagcugcuggcccccaaccccgacguguucgugagccugagcgugcuggacaucacccacaacaaguucaucugcgagugcgagcugagcaccuucaucaacuggcugaaccacaccaacgugaccaucgccggcccccccgccgacaucuacugcguguaccccgacagcuucagcggcgugagccuguucagccugagcaccgagggcugcgacgaggaggaggugcugaagagccugaaguucagccuguucuucgugugcaccgugacccugacccuguuccugaugaccauccugaccgugaccaaguucagaggcuucugcuucaucugcuacaagaccgcccagagacugguguucaaggaccacccccagggcaccgagcccgacauguacaaguacgacgccuaccugugcuucagcagcaaggacuucaccugggugcagaacgcccugcugaagcaccuggacacccaguacagcgaccagaacagauucaaccugugcuucgaggagagagacuucgugcccggcgagaacagaaucgccaacauccaggacgccaucuggaacagcagaaagaucgugugccuggugagcagacacuuccugagagacggcuggugccuggaggccuucagcuacgcccagggcagaugccugagcgaccugaacagcgcccugaucauggugguggugggcagccugagccaguaccagcugaugaagcaccagagcaucagaggcuucgugcagaagcagcaguaccugagauggcccgaggaccugcaggacgugggcugguuccugcacaagcugagccagcagauccugaagaaggagaaggagaagaagaaggacaacaacaucccccugcagaccguggccaccaucagcuga

SEQ ID NO: 9619 - RNA, 2577 nt, Artificial Sequence
  derived and/or modified sequence opt5 from TLR5__Homo_sapiens__AAZ17465
augggcgaccaccuggaucuccugcuuggggugguccugauggccggacccguuuucggcaucccuagcugcuccuuugacgggagaauugcuuucuaccgguuuuguaaccucacccaggugccgcaagugcugaauacaacggagcgccuucugcucucuuucaacuauaucagaaccgucacagccagcuccuuucccuuccuggaacagcugcagcuccuggagcuuggaucucaguacauuccucugaccaucgauaaggaagcguuucggaaucuccccaaccugcgcauucuugaccugggcagcuccaaaaucuauuuccuccauccugaugcuuuucaagggcuguuccaccuguuugagcucagacuguacuucugcggacuuucugacgccgugcugaaggauggcuauuuucggaaucucaaagcccugacacgccuugaccugagcaagaaccagaucagaucccucuaccugcaucccagcuucggcaaacucaauucucucaaguccauugauuucagcucuaaccagaucuuucugguuugugaacacgagcuugagccucugcaggggaagacccucuccuucuuuagccuggcugccaauucucuuuauucccgggugagcgucgacuggggaaaaugcaugaacccguuccgcaauauggugcuggaaauucucgauguuuccggcaacggguggacaguggacaucaccggaaauuuuucuaacgcuauuagcaagucccaagccuucagccugauccuggcgcaucacauuaugggcgccggguuuggauuccacaauaucaaagaucccgaccagaacacguuugcuggccucgccagaucuuccguccggcaucuggaccuuagccacggcuucguguuuucucugaacagccgcguguucgagacccucaaggaucugaaaguccugaaucuugcuuacaacaagaucaauaagauugccgacgaagcguuuuacgggcucgauaaccugcagguucugaaucucuccuauaaccugcuuggagagcuguacucuagcaauuucuauggccucccuaaaguggccuacaucgaccugcagaagaaccauauugcuaucauucaagaucagacauucaaauuucuggagaagcugcagacccucgaccugagagauaaugcccugacaaccauccacuucauccccuccauuccugacaucuuucucagcgggaacaaacuggugacgcuucccaagauuaaucugacagcuaaccucauccaccugucugaaaaucggcuggagaaccuugauauucucuauuuccugcugcgcgucccgcaucuccaaauccugauccuuaaucagaacagauuuuccagcuguucuggagaccagaccccuuccgaaaaccccagccuggagcagcuguuccugggcgaaaauaugcugcaacuugccugggagacagagcucugcugggauguguuugaagggcugucccaucugcagguucucuaccugaaccacaauuaucuuaacucucugccucccggaguguucagccaccucaccgcccugcggggccugucccuuaauucuaacagacugaccguccucagccauaaugaccugcccgcuaaccucgagauucuggacaucucccgcaaucagcuucuggcgccuaacccggauguguuuguuagccucucugugcuggacauuacacacaauaaauucaucugugaaugcgagcuguccacguuuauuaacuggcuuaaucacaccaacgucacaaucgccgggcccccugcugauauuuacuguguguaccccgacagcuucucuggcgucucccuguuuagccucucuaccgaaggaugcgaugaggaggaagugcuuaagagccucaaguucucccuguucuuuguuuguacagugacccuuacgcuguuccucaugacaauccugaccgucaccaaauuucggggcuucugcuuuaucugcuauaagacagcccagagacugguguucaaagaccauccucaagggaccgagcccgauauguacaaguaugacgccuaccuuuguuuuagcucuaaagauuucacauggguucagaaugcucugcucaagcaccuggacacgcaguauuccgaucagaaccgcuuuaaccucugcuucgaggaacgggacuuugugccgggagaaaauagaauugccaacauccaagaugcgauuuggaauagccgcaagaucgucugucuggugucccggcauuuccuuagagacggcuggugccuggaggcuuucucuuacgcccaggggcgcugucugagcgaccucaacuccgcccugauuauggugguugucggcucucuuagccaguaucagcugaugaaacaccaauccauccggggauuugugcagaagcagcaauaccucagauggccugaggaucugcaggacgugggcugguuccuccacaaacugucucagcagauccuuaagaaagaaaaggagaagaaaaaggauaauaacauuccccugcaaaccgucgcuacaaucagcuga

SEQ ID NO: 9620 - protein, 858 aa, Artificial Sequence [sequence omitted]

SEQ ID NO: 9621 - RNA, 2577 nt, Artificial Sequence
  TLR5__Homo_sapiens__AAZ17466
augggagaccaccuggaccuucuccuaggaguggugcucauggccgguccuguguuuggaauuccuuccugcuccuuugauggccgaauagccuuuuaucguuucugcaaccucacccaggucccccagguccucaacaccacugagaggcuccugcugagcuucaacuauaucaggacagucacugcuucauccuuccccuuucuggaacagcugcagcugcuggagcucgggagccaguauacccccuugacuauugacaaggaggccuucagaaaccugcccaaccuuagaaucuuggaccugggaaguaguaagauauacuucuugcauccagaugcuuuucagggacuguuccaucuguuugaacuuagacuguauuucuguggucucucugaugcuguauugaaagaugguuauuucagaaauuuaaaggcuuuaacucgcuuggaucuauccaaaaaucagauucguagccuuuaccuucauccuucauuugggaaguugaauuccuuaaaguccauagauuuuuccuccaacaaaauauuccuuguaugugaacaugagcucgagccccuacaagggaaaacgcucuccuuuuuuagccucgcagcuaauagcuuguauagcagagucucaguggacuggggaaaauguaugaacccauucagaaacauggugcuggagauacuagauguuucuggaaauggcuggacaguggacaucacaggaaacuuuagcaaugccaucagcaaaagccaggccuucucuuugauucuugcccaccacaucaugggugccggguuuggcuuccauaacaucaaagauccugaccagaacacauuugcuggccuggccagaaguucagugagacaccuggaucuuucacauggguuugucuucucccugaacucacgagucuuugagacacucaaggauuugaagguucugaaccuugccuacaacaagauaaauaagauugcagaugaagcauuuuacggacuugacaaccuccaaguucucaauuugucauauaaccuucugggggaacuuuacaguucgaauuucuauggacuaccuaagguagccuacauugauuugcaaaagaaucacauugcaauaauucaagaccaaacauucaaauuccuggaaaaauuacagaccuuggaucuccgagacaaugcucuuacaaccauucauuuuauuccaagcauacccgauaucuucuugaguggcaauaaacuagugacuuugccaaagaucaaccuuacagcgaaccucauccacuuaucagaaaacaggcuagaaaaucuagauauucucuacuuucuccuacggguaccucaucuccagauucucauuuuaaaucaaaaucgcuucuccuccuguaguggagaucaaaccccuucagagaaucccagcuuagaacagcuuuuccuuggagaaaauauguugcaacuugccugggaaacugagcucuguugggauguuuuugagggacuuucucaucuucaaguucuguauuugaaucauaacuaucuuaauucccuuccaccaggaguauuuagccaucugacugcauuaaggggacuaagccucaacuccaacaggcugacaguucuuucucacaaugauuuaccugcuaauuuagagauccuggacauauccaggaaccagcuccuagcuccuaauccugauguauuuguaucacuuagugucuuggauauaacucauaacaaguucauuugugaaugugaacuuagcacuuuuaucaauuggcuuaaucacaccaaugucacuauagcugggccuccugcagacauauauuguguguacccugacucgcucucugggguuucccucuucucucuuuccacggaagguugugaugaagaggaagucuuaaagucccuaaaguucucccuuuucuuuguaugcacugucacucugacucuguuccucaugaccauccucacagucacaaaguuccggggcuucuguuuuaucuguuauaagacagcccagagacugguguucaaggaccauccccagggcacagaaccugauauguacaaauaugaugccuauuugugcuucagcagcaaagacuucacaugggugcagaaugcuuugcucaaacaccuggacacucaauacagugaccaaaacagauucaaccugugcuuugaagaaagagacuuugucccaggagaaaaccgcauugccaauauccaggaugccaucuggaacaguagaaagaucguuugucuugugagcagacacuuccuuagagauggcuggugccuugaagccuucaguuaugcccagggcaggugcuuaucugaccuuaacagugcucucaucaugguggugguuggguccuugucccaguaccaguugaugaaacaucaauccaucagaggcuuuguacagaaacagcaguauuugagguggccugaggaucuccaggauguuggcugguuucuucauaaacucucucaacagauacuaaagaaagaaaaagaaaagaagaaagacaauaacauuccguugcaaacuguagcaaccaucuccuaa

SEQ ID NO: 9622 - RNA, 2577 nt, Artificial Sequence
  derived and/or modified sequence opt1 from TLR5__Homo_sapiens__AAZ17466
augggcgaccaccuggaccuccugcugggggugguccucauggccggccccguguucgggaucccgagcugcuccuucgacggccgcaucgccuucuaccgguucugcaaccugacccaggugccccagguccugaacaccacggagcgccuccugcugagcuucaacuacauccggaccgugaccgcguccagcuuccccuuccucgagcagcugcagcugcucgagcuggggucccaguacacgccccugaccaucgacaaggaggccuuccgcaaccucccgaaccugcggauccuggaccucggcagcuccaagaucuacuuccugcaccccgacgccuuccagggccuguuccaccucuucgagcugcgccuguacuucugcgggcucagcgacgccgugcugaaggacggcuacuuccggaaccugaaggcccucacccgccuggaccuguccaagaaccagauccggagccucuaccugcaccccuccuucgggaagcugaacagccucaaguccaucgacuucagcuccaacaagaucuuccuggucugcgagcacgagcuggagccccuccagggcaagacccugagcuucuucucccuggcggccaacagccucuacucccgcgugagcguggacugggggaagugcaugaacccguuccggaacaugguccuggagauccuggacgugagcggcaacggcuggaccguggacaucacggggaacuucuccaacgccaucagcaagucccaggccuucagccucauccuggcgcaccacaucaugggcgccggguucggcuuccacaacaucaaggaccccgaccagaacaccuucgccggccuggcccgcuccagcguccggcaccucgaccugucccacggguucguguucagccugaacucccgcguguucgagacccucaaggaccugaagguccugaaccuggccuacaacaagaucaacaagaucgcggacgaggccuucuacggccucgacaaccuccaggugcugaaccugagcuacaaccugcugggggagcucuacuccagcaacuucuacggccugcccaagguggccuacaucgaccugcagaagaaccacaucgccaucauccaggaccagaccuucaaguuccucgagaagcugcagacgcuggaccuccgggacaacgcccugaccaccauccacuucauccccuccaucccggacaucuuccugagcgggaacaagcucgucacccugcccaagaucaaccugacggcgaaccucauccaccuguccgagaaccgccuggagaaccucgacauccuguacuuccugcuccgggugccccaccuccagauccugauccugaaccagaaccgcuucagcuccugcagcggcgaccagacccccuccgagaacccgagccuggagcagcuguuccucggcgagaacaugcugcagcuggccugggagaccgagcucugcugggacguguucgaggggcugagccaccuccagguccuguaccugaaccacaacuaccugaacucccucccgcccggcguguucagccaccugaccgcccugcgggggcucucccugaacagcaaccgccugacggugcucucccacaacgaccugcccgccaaccuggagauccucgacaucagccggaaccagcugcuggcccccaaccccgacgucuucgugucccucagcguccuggacaucacccacaacaaguucaucugcgagugcgagcuguccaccuucaucaacuggcucaaccacaccaacgugacgaucgcgggcccgcccgccgacaucuacugcguguaccccgacagccuguccggggucagccuguucucccucagcaccgagggcugcgacgaggaggaggugcugaagucccugaaguucagccucuucuucgugugcaccgucacccugacgcuguuccucaugaccauccugaccgugaccaaguuccgcggcuucugcuucaucugcuacaagacggcccagcgccugguguucaaggaccacccccaggggaccgagcccgacauguacaaguacgacgccuaccucugcuucuccagcaaggacuucaccuggguccagaacgcccugcugaagcaccucgacacccaguacagcgaccagaaccgguucaaccugugcuucgaggagcgcgacuucgugcccggcgagaaccggaucgcgaacauccaggacgccaucuggaacucccgcaagaucgugugccuggucagccggcacuuccuccgcgacggguggugccuggaggccuucuccuacgcccagggccggugccugagcgaccucaacuccgcgcugaucauggugguggucgggagccugucccaguaccagcucaugaagcaccagagcauccgcggcuucgugcagaagcagcaguaccugcgguggccggaggaccugcaggacgugggcugguuccuccacaagcugucccagcagauccugaagaaggagaaggagaagaagaaggacaacaacaucccccuccagacggucgccaccaucagcuga

SEQ ID NO: 9623 - RNA, 2577 nt, Artificial Sequence
  derived and/or modified sequence opt2 from TLR5__Homo_sapiens__AAZ17466
augggcgaccaccucgaccuccuccucggcgucguccucauggccggccccgucuucggcauccccuccugcuccuucgacggccgcaucgccuucuaccgcuucugcaaccucacccaggucccccagguccucaacaccaccgagcgccuccuccucuccuucaacuacauccgcaccgucaccgccuccuccuuccccuuccucgagcagcuccagcuccucgagcucggcucccaguacaccccccucaccaucgacaaggaggccuuccgcaaccuccccaaccuccgcauccucgaccucggcuccuccaagaucuacuuccuccaccccgacgccuuccagggccucuuccaccucuucgagcuccgccucuacuucugcggccucuccgacgccguccucaaggacggcuacuuccgcaaccucaaggcccucacccgccucgaccucuccaagaaccagauccgcucccucuaccuccaccccuccuucggcaagcucaacucccucaaguccaucgacuucuccuccaacaagaucuuccucgucugcgagcacgagcucgagccccuccagggcaagacccucuccuucuucucccucgccgccaacucccucuacucccgcgucuccgucgacuggggcaagugcaugaaccccuuccgcaacaugguccucgagauccucgacgucuccggcaacggcuggaccgucgacaucaccggcaacuucuccaacgccaucuccaagucccaggccuucucccucauccucgcccaccacaucaugggcgccggcuucggcuuccacaacaucaaggaccccgaccagaacaccuucgccggccucgcccgcuccuccguccgccaccucgaccucucccacggcuucgucuucucccucaacucccgcgucuucgagacccucaaggaccucaagguccucaaccucgccuacaacaagaucaacaagaucgccgacgaggccuucuacggccucgacaaccuccagguccucaaccucuccuacaaccuccucggcgagcucuacuccuccaacuucuacggccuccccaaggucgccuacaucgaccuccagaagaaccacaucgccaucauccaggaccagaccuucaaguuccucgagaagcuccagacccucgaccuccgcgacaacgcccucaccaccauccacuucauccccuccauccccgacaucuuccucuccggcaacaagcucgucacccuccccaagaucaaccucaccgccaaccucauccaccucuccgagaaccgccucgagaaccucgacauccucuacuuccuccuccgcgucccccaccuccagauccucauccucaaccagaaccgcuucuccuccugcuccggcgaccagacccccuccgagaaccccucccucgagcagcucuuccucggcgagaacaugcuccagcucgccugggagaccgagcucugcugggacgucuucgagggccucucccaccuccagguccucuaccucaaccacaacuaccucaacucccucccccccggcgucuucucccaccucaccgcccuccgcggccucucccucaacuccaaccgccucaccguccucucccacaacgaccuccccgccaaccucgagauccucgacaucucccgcaaccagcuccucgcccccaaccccgacgucuucgucucccucuccguccucgacaucacccacaacaaguucaucugcgagugcgagcucuccaccuucaucaacuggcucaaccacaccaacgucaccaucgccggcccccccgccgacaucuacugcgucuaccccgacucccucuccggcgucucccucuucucccucuccaccgagggcugcgacgaggaggagguccucaagucccucaaguucucccucuucuucgucugcaccgucacccucacccucuuccucaugaccauccucaccgucaccaaguuccgcggcuucugcuucaucugcuacaagaccgcccagcgccucgucuucaaggaccacccccagggcaccgagcccgacauguacaaguacgacgccuaccucugcuucuccuccaaggacuucaccuggguccagaacgcccuccucaagcaccucgacacccaguacuccgaccagaaccgcuucaaccucugcuucgaggagcgcgacuucguccccggcgagaaccgcaucgccaacauccaggacgccaucuggaacucccgcaagaucgucugccucgucucccgccacuuccuccgcgacggcuggugccucgaggccuucuccuacgcccagggccgcugccucuccgaccucaacuccgcccucaucauggucgucgucggcucccucucccaguaccagcucaugaagcaccaguccauccgcggcuucguccagaagcagcaguaccuccgcuggcccgaggaccuccaggacgucggcugguuccuccacaagcucucccagcagauccucaagaaggagaaggagaagaagaaggacaacaacaucccccuccagaccgucgccaccaucuccuga

SEQ ID NO: 9624 - RNA, 2577 nt, Artificial Sequence
  derived and/or modified sequence opt3 from TLR5__Homo_sapiens__AAZ17466
augggcgaccaccuggaucuccuucuggggguggucuugauggccggacccguuuucgguaucccuagcugcuccuuugacggcagaauugcuuucuacagguuuuguaacuuaacccaggugccacaaguacugaauacaacugagcggcuacuccugucuuucaacuauauacgcacggugaccgcaucaaguuuuccguuccuugaacagcugcaguugcucgagcuggggagccaguacacaccccugacuaucgauaaggaagccuuucgaaaucucccuaacuuacguauucuggaccuuggauccucuaaaaucuauuucuugcauccagaugcguuucaaggccuguuccaccuauuugagcucagacuguacuucugcggucuuucggacgcuguccugaaggauggguauuuuaggaauuugaaagcccucacccggcuggacuuaucaaagaaccagauucgcagccuguaccuccaucccaguuucggaaaacuuaauucccugaagucuaucgauuucagcuccaacaagauauuuuuggugugugaacacgagcuagagccucugcagggcaaaacacucucauucuuuagucuggcagccaauagccuuuauucuagaguuuccguggacuggggcaagugcaugaacccauucaggaauaugguccuggaaaucuuggaugugucagggaacggauggaccguagacauuacugguaauuuuagcaacgcuaucaguaaaucucaggcauucucccucauucuggcccaucacaucaugggcgcuggguuuggauuccacaauauaaaggaucccgaccaaaacacauuugccggcuuagcgcggagcucgguucgccaucuggaccuaucucacgguuucguguuuucccucaacucacgagucuucgagacccugaaagaucuuaagguguugaaucuggcauacaacaagauuaauaaaaucgccgacgaggcuuuuuacgggcucgauaaccuucaggugcugaaucugaguuauaacuugcucggagaacuguacagcuccaauuucuauggcuuaccuaaggucgccuacauugaccugcagaaaaaccauaucgcaaucauucaggaucaaacguucaaguuucuagagaaacuccagacucuggaccuuagagauaaugcuuugaccacaauacacuucaucccaucuauuccggacaucuuucugagcggcaacaagcucguuacucugcccaaaauaaauuuaaccgccaaccugauucaccuuucagaaaauagguuggagaaccucgauauccuguauuuccuacugcgggugccucaucuccagauccugauucuuaaucaaaaccguuuuaguuccuguagcggggaccagacaccaucugaaaaccccucauuggagcagcuguucuuaggagaaaauaugcuccagcuggcgugggagaccgagcuuugcugggauguauuugaaggucugagucacuugcaagugcucuaccugaaccauaauuaucuaaacagccugccuccaggcgucuucucccaccucacggcccugcgcgggcuuucuuugaacucgaauagacugacuguguuaagccauaaugaccuccccgcaaaccuggagauccuugacauuuccaggaaucagcugcuagcuccgaacccugauguuuuugugucacucaguguccuggacauaacacacaauaaguucaucugugaaugcgaguugucuaccuuuauuaacuggcugaaucacacuaacgugacaaucgccggacccccagcugauaucuacuguguauacccugacagcuuauccggcguuucacucuucagccugucuaccgaagguugcgaugaggaggaagugcuuaagucccugaaauuuaguuuguucuucgucuguacggugacccucacacuguuucuaaugacuauucugaccgucacaaaguuccggggguuuugcuucauaugcuauaaaacugcccagcgacuuguguuuaaggaccauccccagggcaccgagccagauauguacaaauaugacgcauaccucuguuucagcucuaaggauuuuacauggguucaaaaugcccuguugaagcaccuggacacccaguauuccgaucagaaccgcuucaacuuaugcuuugaagagagagacuucgugcccggagaaaauaggaucgcuaacauucaggaugcgaucuggaauagucggaaaauuguaugucucgucucacgccauuuucugagagacggcuggugccuugaggcauucagcuacgcccaagggaggugucugucggacuugaacuccgcucucaucauggugguugugggaucucugagccaguaucagcuaaugaagcaccagucaauacgugguuucguccaaaaacagcaguaccugcgguggccugaggaucuucaagacgugggcugguuucuccacaagcugagucagcagaucuugaaaaaggaaaaggagaaaaagaaagauaauaacauuccauuacagacuguagccacgaucuccuga

SEQ ID NO: 9625 - RNA, 2577 nt, Artificial Sequence
  derived and/or modified sequence opt4 from TLR5__Homo_sapiens__AAZ17466
augggcgaccaccuggaccugcugcugggcguggugcugauggccggccccguguucggcauccccagcugcagcuucgacggcagaaucgccuucuacagauucugcaaccugacccaggugccccaggugcugaacaccaccgagagacugcugcugagcuucaacuacaucagaaccgugaccgccagcagcuuccccuuccuggagcagcugcagcugcuggagcugggcagccaguacaccccccugaccaucgacaaggaggccuucagaaaccugcccaaccugagaauccuggaccugggcagcagcaagaucuacuuccugcaccccgacgccuuccagggccuguuccaccuguucgagcugagacuguacuucugcggccugagcgacgccgugcugaaggacggcuacuucagaaaccugaaggcccugaccagacuggaccugagcaagaaccagaucagaagccuguaccugcaccccagcuucggcaagcugaacagccugaagagcaucgacuucagcagcaacaagaucuuccuggugugcgagcacgagcuggagccccugcagggcaagacccugagcuucuucagccuggccgccaacagccuguacagcagagugagcguggacuggggcaagugcaugaaccccuucagaaacauggugcuggagauccuggacgugagcggcaacggcuggaccguggacaucaccggcaacuucagcaacgccaucagcaagagccaggccuucagccugauccuggcccaccacaucaugggcgccggcuucggcuuccacaacaucaaggaccccgaccagaacaccuucgccggccuggccagaagcagcgugagacaccuggaccugagccacggcuucguguucagccugaacagcagaguguucgagacccugaaggaccugaaggugcugaaccuggccuacaacaagaucaacaagaucgccgacgaggccuucuacggccuggacaaccugcaggugcugaaccugagcuacaaccugcugggcgagcuguacagcagcaacuucuacggccugcccaagguggccuacaucgaccugcagaagaaccacaucgccaucauccaggaccagaccuucaaguuccuggagaagcugcagacccuggaccugagagacaacgcccugaccaccauccacuucauccccagcauccccgacaucuuccugagcggcaacaagcuggugacccugcccaagaucaaccugaccgccaaccugauccaccugagcgagaacagacuggagaaccuggacauccuguacuuccugcugagagugccccaccugcagauccugauccugaaccagaacagauucagcagcugcagcggcgaccagacccccagcgagaaccccagccuggagcagcuguuccugggcgagaacaugcugcagcuggccugggagaccgagcugugcugggacguguucgagggccugagccaccugcaggugcuguaccugaaccacaacuaccugaacagccugccccccggcguguucagccaccugaccgcccugagaggccugagccugaacagcaacagacugaccgugcugagccacaacgaccugcccgccaaccuggagauccuggacaucagcagaaaccagcugcuggcccccaaccccgacguguucgugagccugagcgugcuggacaucacccacaacaaguucaucugcgagugcgagcugagcaccuucaucaacuggcugaaccacaccaacgugaccaucgccggcccccccgccgacaucuacugcguguaccccgacagccugagcggcgugagccuguucagccugagcaccgagggcugcgacgaggaggaggugcugaagagccugaaguucagccuguucuucgugugcaccgugacccugacccuguuccugaugaccauccugaccgugaccaaguucagaggcuucugcuucaucugcuacaagaccgcccagagacugguguucaaggaccacccccagggcaccgagcccgacauguacaaguacgacgccuaccugugcuucagcagcaaggacuucaccugggugcagaacgcccugcugaagcaccuggacacccaguacagcgaccagaacagauucaaccugugcuucgaggagagagacuucgugcccggcgagaacagaaucgccaacauccaggacgccaucuggaacagcagaaagaucgugugccuggugagcagacacuuccugagagacggcuggugccuggaggccuucagcuacgcccagggcagaugccugagcgaccugaacagcgcccugaucauggugguggugggcagccugagccaguaccagcugaugaagcaccagagcaucagaggcuucgugcagaagcagcaguaccugagauggcccgaggaccugcaggacgugggcugguuccugcacaagcugagccagcagauccugaagaaggagaaggagaagaagaaggacaacaacaucccccugcagaccguggccaccaucagcuga

SEQ ID NO: 9626 - RNA, 2577 nt, Artificial Sequence
  derived and/or modified sequence opt5 from TLR5__Homo_sapiens__AAZ17466
augggcgaccaccuggaucuccugcuuggggugguccugauggccggacccguuuucggcaucccuagcugcuccuuugacgggagaauugcuuucuaccgguuuuguaaccucacccaggugccgcaagugcugaauacaacggagcgccuucugcucucuuucaacuauaucagaaccgucacagccagcuccuuucccuuccuggaacagcugcagcuccuggagcuuggaucucaguacaccccucugacaauugauaaggaagcguuucggaaucuccccaaccugcgcauccuugaccugggcagcuccaaaauuuauuuccuccauccugaugcuuuucaagggcuguuccaccuguuugagcucagacuguacuucugcggacuuucugacgccgugcugaaggauggcuauuuucggaaucucaaagcccugacccgccuugaccugagcaagaaccagaucagaucccucuaccugcaucccagcuucggcaaacucaauucucucaaguccaucgauuucagcucuaacaagauuuuucugguuugugaacacgagcuugagccucugcaggggaaaacacucuccuucuuuagccuggcugccaauucucuuuauucccgggugagcgucgacuggggaaagugcaugaacccguuccgcaauauggugcuggaaauccucgauguuuccggcaacggguggaccguggacauuacgggaaauuuuucuaacgcuaucagcaaaucccaggccuucagccugauucuggcgcaucacaucaugggcgccggguuuggauuccacaauauuaaggaucccgaccaaaacaccuuugcuggccucgccagaucuuccguccggcaucuggaccuuagccacggcuucguguuuucucugaacagccgcguguucgagacacucaaagaucugaagguccugaaucuugcuuacaacaagaucaauaaaaucgccgacgaagcguuuuacgggcucgauaaccugcagguucugaaucucuccuauaaccugcuuggagagcuguacucuagcaauuucuauggccucccuaagguggccuacauugaccugcagaaaaaccauaucgcuauuauccaggaucaaaccuucaaguuucuggagaaacuucagacacucgaccugagagauaaugcccugaccacgauucacuucauccccuccaucccugacauuuuucucagcgggaacaagcuggugacacuucccaaaaucaaucugaccgcuaaccucauucaccugucugaaaaucggcuggagaaccuugauauccucuauuuccugcugcgcgucccgcaucuccagauucugauccuuaaucaaaacagauuuuccagcuguucuggagaccagacaccuuccgaaaaccccagccuggagcagcuguuccugggcgaaaauaugcugcagcuugccugggagaccgagcucugcugggauguguuugaagggcugucccaccuucaaguucucuaccugaaccauaauuaucuuaacucucugccucccggaguguucagccaccucaccgcccugcggggccugucccuuaauucuaacagacugacaguccucagccauaaugaccugcccgcuaaccucgagauccuggacauuucccgcaaucagcuucuggcgccuaacccggauguguuuguuagccucucugugcuggacaucacgcacaauaaguucauuugugaaugcgagcuguccaccuuuaucaacuggcuuaaucacacaaacgucaccauugccgggcccccugcugauaucuacuguguguaccccgacagccugucuggcgucucccucuucagccugucuacagaaggaugcgaugaggaggaagugcucaagagccugaaauuuucccuuuucuucguuuguaccgugacgcugacacucuuucugaugaccauucugaccgucacaaaguuccggggcuuuugcuucaucugcuauaaaaccgcccagagacuuguguuuaaggaccauccucaggggacagagcccgauauguacaaauaugacgccuaccuguguuucagcucuaaggauuuuacguggguucaaaaugcucuccugaagcaccucgacacccaguauuccgaucagaaccgcuucaaccugugcuuugaggaacgggacuucgugccgggagaaaauagaaucgccaacauucaggaugcgaucuggaauagccgcaaaauugucugucuugugucccggcauuuucugagagacggcuggugccuggaggcuuucucuuacgcccaagggcgcugucucagcgaccugaacuccgcccuuaucauggugguugucggcucucugagccaguaucagcucaugaagcaccaguccauucggggauucgugcaaaaacagcaguaccugagauggccugaggaucuccaagacgugggcugguuucugcacaagcugucucagcagauccugaaaaaggaaaaggagaaaaagaaagauaauaacaucccccugcagacagucgcuaccauuagcuga

SEQ ID NO: 9627 - protein, 858 aa, Artificial Sequence [sequence omitted]

SEQ ID NO: 9628 - RNA, 2577 nt, Artificial Sequence
  TLR5__Homo_sapiens__AAZ17467
augggagaccaccuggaccuucuccuaggaguggugcucauggccgguccuguguuuggaauuccuuccugcuccuuugauggccgaauagccuuuuaucguuucugcaaccucacccaggucccccagguccucaacaccacugagaggcuccugcugagcuucaacuauaucaggacagucacugcuucauccuuccccuuucuggaacagcugcagcugcuggagcucgggagccaguauacccccuugacuauugacaaggaggccuucagaaaccugcccaaccuuagaaucuuggaccugggaaguaguaagauauacuucuugcauccagaugcuuuucagggacuguuccaucuguuugaacuuagacuguauuucuguggucucucugaugcuguauugaaagaugguuauuucagaaauuuaaaggcuuuaacucgcuuggaucuauccaaaaaucagauucguagccuuuaccuucauccuucauuugggaaguugaauuccuuaaaguccauagauuuuuccuccaaccaaauauuccuuguaugugaacaugagcucgagccccuacaagggaaaacgcucuccuuuuuuagccucgcagcuaauagcuuguauagcagagucucaguggacuggggaaaauguaugaacccauucagaaacauggugcuggagauacuagauguuucuggaaauggcuggacaguggacaucacaggaaacuuuagcaaugccaucagcaaaagccaggccuucucuuugauucuugcccaccacaucaugggugccggguuuggcuuccauaacaucaaagauccugaccagaacacauuugcuggccuggccagaaguucagugagacaccuggaucuuucacauggguuugucuucucccugaacucacgagucuuugagacacucaaggauuugaagguucugaaccuugccuacaacaagauaaauaagauugcagaugaagcauuuuacggacuugacaaccuccaaguucucaauuugucauauaaccuucugggggaacuuuacaguucgaauuucuauggacuaccuaagguagccuacauugauuugcaaaagaaucacauugcaauaauucaagaccaaacauucaaauuccuggaaaaauuacagaccuuggaucuccgagacaaugcucuuacaaccauucauuuuauuccaagcauacccgauaucuucuugaguggcaauaaacuagugacuuugccaaagaucaaccuuacagcgaaccucauccacuuaucagaaaacaggcuagaaaaucuagauauucucuacuuucuccuacggguaccucaucuccagauucucauuuuaaaucaaaaucgcuucuccuccuguaguggagaucaaaccccuucagagaaucccagcuuagaacagcuuuuccuuggagaaaauauauugcaaauugccugggaaacugagcucuguugggauguuuuugagggacuuucucaucuucaaguucuguauuugaaucauaacuaucuuaauucccuuccaccaggaguauuuagccaucugacugcauuaaggggacuaagccucaacuccaacaggcugacaguucuuucucacaaugauuuaccugcuaauuuagagauccuggacauauccaggaaccagcuccuagcuccuaauccugauguauuuguaucacuuagugucuuggauauaacucauaacaaguucauuugugaaugugaacuuagcacuuuuaucaauuggcuuaaucacaccaaugucacuauagcugggccuccugcagacauauauuguguguacccugacucgcucucugggguuucccucuucucucuuuccacggaagguugugaugaagaggaagucuuaaagucccuaaaguucucccuuuucuuuguaugcacugucacucugacucuguuccucaugaccauccucacagucacaaaguuccggggcuucuguuuuaucuguuauaagacagcccagagacugguguucaaggaccauccccagggcacagaaccugauauguacaaauaugaugccuauuugugcuucagcagcaaagacuucacaugggugcagaaugcuuugcucaaacaccuggacacucaauacagugaccaaaacagauucaaccugugcuuugaagaaagagacuuugucccaggagaaaaccgcauugccaauauccaggaugccaucuggaacaguagaaagaucguuugucuugugagcagacacuuccuuagagauggcuggugccuugaagccuucaguuaugcccagggcaggugcuuaucugaccuuaacagugcucucaucaugguggugguuggguccuugucccaguaccaguugaugaaacaucaauccaucagaggcuuuguacagaaacagcaguauuugagguggccugaggaucuccaggauguuggcugguuucuucauaagcucucucaacagauacuaaagaaagaaaaagaaaagaagaaaggcaauaacauuccguugcaaacuguagcaaccaucuccuaa

SEQ ID NO: 9629 - RNA, 2577 nt, Artificial Sequence
  derived and/or modified sequence opt1 from TLR5__Homo_sapiens__AAZ17467
augggcgaccaccuggaccuccugcugggggugguccucauggccggccccguguucgggaucccgagcugcuccuucgacggccgcaucgccuucuaccgguucugcaaccugacccaggugccccagguccugaacaccacggagcgccuccugcugagcuucaacuacauccggaccgugaccgcguccagcuuccccuuccucgagcagcugcagcugcucgagcuggggucccaguacacgccccugaccaucgacaaggaggccuuccgcaaccucccgaaccugcggauccuggaccucggcagcuccaagaucuacuuccugcaccccgacgccuuccagggccuguuccaccucuucgagcugcgccuguacuucugcgggcucagcgacgccgugcugaaggacggcuacuuccggaaccugaaggcccucacccgccuggaccuguccaagaaccagauccggagccucuaccugcaccccuccuucgggaagcugaacagccucaaguccaucgacuucagcuccaaccagaucuuccuggucugcgagcacgagcuggagccccuccagggcaagacccugagcuucuucucccuggcggccaacagccucuacucccgcgugagcguggacugggggaagugcaugaacccguuccggaacaugguccuggagauccuggacgugagcggcaacggcuggaccguggacaucacggggaacuucuccaacgccaucagcaagucccaggccuucagccucauccuggcgcaccacaucaugggcgccggguucggcuuccacaacaucaaggaccccgaccagaacaccuucgccggccuggcccgcuccagcguccggcaccucgaccugucccacggguucguguucagccugaacucccgcguguucgagacccucaaggaccugaagguccugaaccuggccuacaacaagaucaacaagaucgcggacgaggccuucuacggccucgacaaccuccaggugcugaaccugagcuacaaccugcugggggagcucuacuccagcaacuucuacggccugcccaagguggccuacaucgaccugcagaagaaccacaucgccaucauccaggaccagaccuucaaguuccucgagaagcugcagacgcuggaccuccgggacaacgcccugaccaccauccacuucauccccuccaucccggacaucuuccugagcgggaacaagcucgucacccugcccaagaucaaccugacggcgaaccucauccaccuguccgagaaccgccuggagaaccucgacauccuguacuuccugcuccgggugccccaccuccagauccugauccugaaccagaaccgcuucagcuccugcagcggcgaccagacccccuccgagaacccgagccuggagcagcuguuccucggcgagaacauccugcagaucgccugggagaccgagcugugcugggacguguucgaggggcucagccaccuccagguccuguaccugaaccacaacuaccugaacucccugccgcccggcguguucagccaccucaccgcccugcgggggcugucccucaacagcaaccgccugacggugcugucccacaacgaccuccccgccaaccuggagauccuggacaucagccggaaccagcuccuggcccccaaccccgacgucuucgugucccugagcguccucgacaucacccacaacaaguucaucugcgagugcgagcuguccaccuucaucaacuggcugaaccacaccaacgugacgaucgcgggcccgcccgccgacaucuacugcguguaccccgacagccucuccggggucagccuguucucccugagcaccgagggcugcgacgaggaggaggugcucaagucccugaaguucagccuguucuucgugugcaccgucacccucacgcuguuccugaugaccauccucaccgugaccaaguuccgcggcuucugcuucaucugcuacaagacggcccagcgccugguguucaaggaccacccccaggggaccgagcccgacauguacaaguacgacgccuaccugugcuucuccagcaaggacuucaccuggguccagaacgcccuccugaagcaccuggacacccaguacagcgaccagaaccgguucaaccucugcuucgaggagcgcgacuucgugcccggcgagaaccggaucgcgaacauccaggacgccaucuggaacucccgcaagaucgugugccuggucagccggcacuuccugcgcgacggguggugccucgaggccuucuccuacgcccagggccggugccugagcgaccugaacuccgcgcucaucauggugguggucgggagccugucccaguaccagcugaugaagcaccagagcauccgcggcuucgugcagaagcagcaguaccuccgguggccggaggaccugcaggacgugggcugguuccugcacaagcucucccagcagauccugaagaaggagaaggagaagaagaaggggaacaacaucccccugcagacggucgccaccaucagcuga

SEQ ID NO: 9630 - RNA, 2577 nt, Artificial Sequence
  derived and/or modified sequence opt2 from TLR5__Homo_sapiens__AAZ17467
augggcgaccaccucgaccuccuccucggcgucguccucauggccggccccgucuucggcauccccuccugcuccuucgacggccgcaucgccuucuaccgcuucugcaaccucacccaggucccccagguccucaacaccaccgagcgccuccuccucuccuucaacuacauccgcaccgucaccgccuccuccuuccccuuccucgagcagcuccagcuccucgagcucggcucccaguacaccccccucaccaucgacaaggaggccuuccgcaaccuccccaaccuccgcauccucgaccucggcuccuccaagaucuacuuccuccaccccgacgccuuccagggccucuuccaccucuucgagcuccgccucuacuucugcggccucuccgacgccguccucaaggacggcuacuuccgcaaccucaaggcccucacccgccucgaccucuccaagaaccagauccgcucccucuaccuccaccccuccuucggcaagcucaacucccucaaguccaucgacuucuccuccaaccagaucuuccucgucugcgagcacgagcucgagccccuccagggcaagacccucuccuucuucucccucgccgccaacucccucuacucccgcgucuccgucgacuggggcaagugcaugaaccccuuccgcaacaugguccucgagauccucgacgucuccggcaacggcuggaccgucgacaucaccggcaacuucuccaacgccaucuccaagucccaggccuucucccucauccucgcccaccacaucaugggcgccggcuucggcuuccacaacaucaaggaccccgaccagaacaccuucgccggccucgcccgcuccuccguccgccaccucgaccucucccacggcuucgucuucucccucaacucccgcgucuucgagacccucaaggaccucaagguccucaaccucgccuacaacaagaucaacaagaucgccgacgaggccuucuacggccucgacaaccuccagguccucaaccucuccuacaaccuccucggcgagcucuacuccuccaacuucuacggccuccccaaggucgccuacaucgaccuccagaagaaccacaucgccaucauccaggaccagaccuucaaguuccucgagaagcuccagacccucgaccuccgcgacaacgcccucaccaccauccacuucauccccuccauccccgacaucuuccucuccggcaacaagcucgucacccuccccaagaucaaccucaccgccaaccucauccaccucuccgagaaccgccucgagaaccucgacauccucuacuuccuccuccgcgucccccaccuccagauccucauccucaaccagaaccgcuucuccuccugcuccggcgaccagacccccuccgagaaccccucccucgagcagcucuuccucggcgagaacauccuccagaucgccugggagaccgagcucugcugggacgucuucgagggccucucccaccuccagguccucuaccucaaccacaacuaccucaacucccucccccccggcgucuucucccaccucaccgcccuccgcggccucucccucaacuccaaccgccucaccguccucucccacaacgaccuccccgccaaccucgagauccucgacaucucccgcaaccagcuccucgcccccaaccccgacgucuucgucucccucuccguccucgacaucacccacaacaaguucaucugcgagugcgagcucuccaccuucaucaacuggcucaaccacaccaacgucaccaucgccggcccccccgccgacaucuacugcgucuaccccgacucccucuccggcgucucccucuucucccucuccaccgagggcugcgacgaggaggagguccucaagucccucaaguucucccucuucuucgucugcaccgucacccucacccucuuccucaugaccauccucaccgucaccaaguuccgcggcuucugcuucaucugcuacaagaccgcccagcgccucgucuucaaggaccacccccagggcaccgagcccgacauguacaaguacgacgccuaccucugcuucuccuccaaggacuucaccuggguccagaacgcccuccucaagcaccucgacacccaguacuccgaccagaaccgcuucaaccucugcuucgaggagcgcgacuucguccccggcgagaaccgcaucgccaacauccaggacgccaucuggaacucccgcaagaucgucugccucgucucccgccacuuccuccgcgacggcuggugccucgaggccuucuccuacgcccagggccgcugccucuccgaccucaacuccgcccucaucauggucgucgucggcucccucucccaguaccagcucaugaagcaccaguccauccgcggcuucguccagaagcagcaguaccuccgcuggcccgaggaccuccaggacgucggcugguuccuccacaagcucucccagcagauccucaagaaggagaaggagaagaagaagggcaacaacaucccccuccagaccgucgccaccaucuccuga

SEQ ID NO: 9631 - RNA, 2577 nt, Artificial Sequence
  derived and/or modified sequence opt3 from TLR5__Homo_sapiens__AAZ17467
augggcgaccaccuggaucuccuucuggggguggucuugauggccggacccguuuucgguaucccuagcugcuccuuugacggcagaauugcuuucuacagguuuuguaacuuaacccaggugccacaaguacugaauacaacugagcggcuacuccugucuuucaacuauauacgcacggugaccgcaucaaguuuuccguuccuugaacagcugcaguugcucgagcuggggagccaguacacaccccugacuaucgauaaggaagccuuucgaaaucucccuaacuuacguauucuggaccuuggauccucuaaaaucuauuucuugcauccagaugcguuucaaggccuguuccaccuauuugagcucagacuguacuucugcggucuuucggacgcuguccugaaggauggguauuuuaggaauuugaaagcccucacccggcuggacuuaucaaagaaccagauucgcagccuguaccuccaucccaguuucggaaaacuuaauucccugaagucuaucgauuucagcuccaaccagauauuuuuggugugugaacacgagcuagagccucugcagggcaagacacucucauucuuuagucuggcagccaauagccuuuauucuagaguuuccguggacuggggcaaaugcaugaacccauucaggaauaugguccuggaaaucuuggaugugucagggaacggauggaccguagacauuacugguaauuuuagcaacgcuaucaguaagucucaagcauucucccucauucuggcccaucacaucaugggcgcuggguuuggauuccacaauauaaaagaucccgaccagaacacauuugccggcuuagcgcggagcucgguucgccaucuggaccuaucucacgguuucguguuuucccucaacucacgagucuucgagacccugaaggaucuuaaaguguugaaucuggcauacaacaagauuaauaagaucgccgacgaggcuuuuuacgggcucgauaaccuucaggugcugaaucugaguuauaacuugcucggagaacuguacagcuccaauuucuauggcuuaccuaaagucgccuacauugaccugcagaagaaccauaucgcaaucauucaagaucagacguucaaauuucuagagaagcuccagacucuggaccuuagagauaaugcuuugaccacaauacacuucaucccaucuauuccggacaucuuucugagcggcaacaaacucguuacucugcccaagauaaauuuaaccgccaaccugauucaccuuucagaaaauagguuggagaaccucgauauccuguauuuccuacugcgggugccucaucuccaaauccugauucuuaaucagaaccguuuuaguuccuguagcggggaccagacaccaucugaaaaccccucauuggagcagcuguucuuaggagaaaauauccuccaaauugcgugggagaccgagcugugcugggauguauuugaaggucuuagucacuugcaagugcuguaccucaaccauaauuaucugaacagccuaccuccaggcgucuucucccaccugacggcccuccgcgggcugucucuuaauucgaacagauugacugugcugagccauaaugacuuacccgcaaaccucgagauacuggacaucuccaggaaucagcuucuggcuccgaacccugauguuuuugugucacuaaguguccucgacauuacacacaauaaauucaucugugaaugcgagcugucuaccuuuaucaacugguugaaucacacuaacgugacaauugccggacccccagcugauauauacuguguauacccugacagccuguccggcguuucauuauucagccucucuaccgaagguugcgaugaggaggaagugcugaagucccuuaaguuuagucuguucuucgucuguacggugaccuugacacucuuucugaugacuauccuaaccgucacaaaauuccggggguuuugcuucauuugcuauaagacugcccagcgacugguguuuaaagaccauccccagggcaccgagccagauauguacaaguaugacgcauaccuuuguuucagcucuaaagauuuuacauggguucagaaugcccuccugaagcacuuggacacccaguauuccgaucagaaccgcuucaaccugugcuuugaagagagagacuucgugcccggagaaaauaggaucgcuaacauucaagaugcgaucuggaauagucggaagauaguauguuuagucucacgccauuuucucagagacggcuggugccuggaggcauucagcuacgcccaggggaggugucuuucggaccugaacuccgcuuugaucauggugguugugggaucucucagccaguaucagcugaugaaacaccaaucaauucgugguuucguccagaagcagcaauaccuacgguggccugaggaucugcaggacgugggcugguuucuucacaaacucagucagcagauccugaagaaagaaaaggagaagaaaaaggggaauaacauuccauugcaaacuguagccacgaucuccuga

SEQ ID NO: 9632 - RNA, 2577 nt, Artificial Sequence
  derived and/or modified sequence opt4 from TLR5__Homo_sapiens__AAZ17467
augggcgaccaccuggaccugcugcugggcguggugcugauggccggccccguguucggcauccccagcugcagcuucgacggcagaaucgccuucuacagauucugcaaccugacccaggugccccaggugcugaacaccaccgagagacugcugcugagcuucaacuacaucagaaccgugaccgccagcagcuuccccuuccuggagcagcugcagcugcuggagcugggcagccaguacaccccccugaccaucgacaaggaggccuucagaaaccugcccaaccugagaauccuggaccugggcagcagcaagaucuacuuccugcaccccgacgccuuccagggccuguuccaccuguucgagcugagacuguacuucugcggccugagcgacgccgugcugaaggacggcuacuucagaaaccugaaggcccugaccagacuggaccugagcaagaaccagaucagaagccuguaccugcaccccagcuucggcaagcugaacagccugaagagcaucgacuucagcagcaaccagaucuuccuggugugcgagcacgagcuggagccccugcagggcaagacccugagcuucuucagccuggccgccaacagccuguacagcagagugagcguggacuggggcaagugcaugaaccccuucagaaacauggugcuggagauccuggacgugagcggcaacggcuggaccguggacaucaccggcaacuucagcaacgccaucagcaagagccaggccuucagccugauccuggcccaccacaucaugggcgccggcuucggcuuccacaacaucaaggaccccgaccagaacaccuucgccggccuggccagaagcagcgugagacaccuggaccugagccacggcuucguguucagccugaacagcagaguguucgagacccugaaggaccugaaggugcugaaccuggccuacaacaagaucaacaagaucgccgacgaggccuucuacggccuggacaaccugcaggugcugaaccugagcuacaaccugcugggcgagcuguacagcagcaacuucuacggccugcccaagguggccuacaucgaccugcagaagaaccacaucgccaucauccaggaccagaccuucaaguuccuggagaagcugcagacccuggaccugagagacaacgcccugaccaccauccacuucauccccagcauccccgacaucuuccugagcggcaacaagcuggugacccugcccaagaucaaccugaccgccaaccugauccaccugagcgagaacagacuggagaaccuggacauccuguacuuccugcugagagugccccaccugcagauccugauccugaaccagaacagauucagcagcugcagcggcgaccagacccccagcgagaaccccagccuggagcagcuguuccugggcgagaacauccugcagaucgccugggagaccgagcugugcugggacguguucgagggccugagccaccugcaggugcuguaccugaaccacaacuaccugaacagccugccccccggcguguucagccaccugaccgcccugagaggccugagccugaacagcaacagacugaccgugcugagccacaacgaccugcccgccaaccuggagauccuggacaucagcagaaaccagcugcuggcccccaaccccgacguguucgugagccugagcgugcuggacaucacccacaacaaguucaucugcgagugcgagcugagcaccuucaucaacuggcugaaccacaccaacgugaccaucgccggcccccccgccgacaucuacugcguguaccccgacagccugagcggcgugagccuguucagccugagcaccgagggcugcgacgaggaggaggugcugaagagccugaaguucagccuguucuucgugugcaccgugacccugacccuguuccugaugaccauccugaccgugaccaaguucagaggcuucugcuucaucugcuacaagaccgcccagagacugguguucaaggaccacccccagggcaccgagcccgacauguacaaguacgacgccuaccugugcuucagcagcaaggacuucaccugggugcagaacgcccugcugaagcaccuggacacccaguacagcgaccagaacagauucaaccugugcuucgaggagagagacuucgugcccggcgagaacagaaucgccaacauccaggacgccaucuggaacagcagaaagaucgugugccuggugagcagacacuuccugagagacggcuggugccuggaggccuucagcuacgcccagggcagaugccugagcgaccugaacagcgcccugaucauggugguggugggcagccugagccaguaccagcugaugaagcaccagagcaucagaggcuucgugcagaagcagcaguaccugagauggcccgaggaccugcaggacgugggcugguuccugcacaagcugagccagcagauccugaagaaggagaaggagaagaagaagggcaacaacaucccccugcagaccguggccaccaucagcuga

SEQ ID NO: 9633 - RNA, 2577 nt, Artificial Sequence
  derived and/or modified sequence opt5 from TLR5__Homo_sapiens__AAZ17467
augggcgaccaccuggaucuccugcuuggggugguccugauggccggacccguuuucggcaucccuagcugcuccuuugacgggagaauugcuuucuaccgguuuuguaaccucacccaggugccgcaagugcugaauacaacggagcgccuucugcucucuuucaacuauaucagaaccgucacagccagcuccuuucccuuccuggaacagcugcagcuccuggagcuuggaucucaguacaccccucugacaauugauaaggaagcguuucggaaucuccccaaccugcgcauccuugaccugggcagcuccaaaauuuauuuccuccauccugaugcuuuucaagggcuguuccaccuguuugagcucagacuguacuucugcggacuuucugacgccgugcugaaggauggcuauuuucggaaucucaaagcccugacccgccuugaccugagcaagaaccagaucagaucccucuaccugcaucccagcuucggcaaacucaauucucucaaguccaucgauuucagcucuaaccagauuuuucugguuugugaacacgagcuugagccucugcaggggaagacacucuccuucuuuagccuggcugccaauucucuuuauucccgggugagcgucgacuggggaaaaugcaugaacccguuccgcaauauggugcuggaaauccucgauguuuccggcaacggguggaccguggacauuacgggaaauuuuucuaacgcuaucagcaagucccaagccuucagccugauucuggcgcaucacaucaugggcgccggguuuggauuccacaauauuaaagaucccgaccagaacaccuuugcuggccucgccagaucuuccguccggcaucuggaccuuagccacggcuucguguuuucucugaacagccgcguguucgagacacucaaggaucugaaaguccugaaucuugcuuacaacaagaucaauaagaucgccgacgaagcguuuuacgggcucgauaaccugcagguucugaaucucuccuauaaccugcuuggagagcuguacucuagcaauuucuauggccucccuaaaguggccuacauugaccugcagaagaaccauaucgcuauuauccaagaucagaccuucaaauuucuggagaagcugcagacacucgaccugagagauaaugcccugaccacgauucacuucauccccuccaucccugacauuuuucucagcgggaacaaacuggugacacuucccaagaucaaucugaccgcuaaccucauucaccugucugaaaaucggcuggagaaccuugauauccucuauuuccugcugcgcgucccgcaucuccaaauucugauccuuaaucagaacagauuuuccagcuguucuggagaccagacaccuuccgaaaaccccagccuggagcagcuguuccugggcgaaaauauccugcaaauugccugggagaccgagcuuugcugggauguguuugaagggcucucccaucugcagguucuguaccucaaccacaauuaucugaacucucuuccucccggaguguucagccaccugaccgcccuccggggccugucccuuaauucuaacagacuuacaguccugagccauaaugaccuccccgcuaaccuggagauccucgacauuucccgcaaucagcugcuugcgccuaacccggauguguuuguuagccugucugugcucgacaucacgcacaauaaauucauuugugaaugcgagcuguccaccuuuaucaacuggcugaaucacacaaacgucaccauugccgggcccccugcugauaucuacuguguguaccccgacagccuuucuggcgucucccuguucagccucucuacagaaggaugcgaugaggaggaagugcucaagagccugaaguuuucccuguucuucguuuguaccgugacgcuuacacuguuucucaugaccauccugaccgucacaaaauuccggggcuuuugcuucauuugcuauaagaccgcccagagacugguguuuaaagaccauccucaagggacagagcccgauauguacaaguaugacgccuaccuuuguuucagcucuaaagauuuuacguggguucagaaugcucugcucaagcaccuggacacccaguauuccgaucagaaccgcuucaaccucugcuuugaggaacgggacuucgugccgggagaaaauagaaucgccaacauucaagaugcgaucuggaauagccgcaagauugucugucuggugucccggcauuuucuuagagacggcuggugccuggaggcuuucucuuacgcccaggggcgcugucugagcgaccucaacuccgcccugaucauggugguugucggcucucuuagccaguaucagcugaugaaacaccaauccauccggggauucgugcagaagcagcaauaccucagauggccugaggaucugcaggacgugggcugguuucuccacaaacugucucagcagauucuuaagaaagaaaaggagaagaaaaaggggaauaacaucccccugcaaacagucgcuaccauuagcuga

SEQ ID NO: 9634 - protein, 858 aa, Artificial Sequence [sequence omitted]

SEQ ID NO: 9635 - RNA, 2577 nt, Artificial Sequence
  TLR5__Homo_sapiens__AAZ17468
augggagaccaccuggaccuucuccuaggaguggugcucauggccgguccuguguuuggaauuccuuccugcuccuuugauggccgaauagccuuuuaucguuucugcaaccucacccaggucccccagguccucaacaccacugagaggcuccugcugagcuucaacuauaucaggacagucacugcuucauccuuccccuuucuggaacagcugcagcugcuggagcucgggagccaguauacccccuugacuauugacaaggaggccuucagaaaccugcccaaccuuagaaucuuggaccugggaaguaguaagauauacuucuugcauccagaugcuuuucagggacuguuccaucuguuugaacuuagacuguauuucuguggucucucugaugcuguauugaaagaugguuauuucagaaauuuaaaggcuuuaacucgcuuggaucuauccaaaaaucagauucguagccuuuaccuucauccuucauuugggaaguugaauuccuuaaaguccauagauuuuuccuccaaccaaauauuccuuguaugugaacaugagcucgagccccuacaagggaaaacgcucuccuuuuuuagccucgcagcuaauagcuuguauagcagagucucaguggacuggggaaaauguaugaacccauucagaaacauggugcuggagauacuagauguuucuggaaauggcuggacaguggacaucacaggaaacuuuagcaaugccaucagcaaaagccaggccuucucuuugauucuugcccaccacaucaugggugccggguuuggcuuccauaacaucaaagauccugaccagaacacauuugcuggccuggccagaaguucagugagacaccuggaucuuucacauggguuugucuucucccugaacucacgagucuuugagacacucaaggauuugaagguucugaaccuugccuacaacaagauaaauaagauugcagaugaagcauuuuacggacuugacaaccuccaaguucucaauuugucauauaaccuucugggggaacuuuacaguucgaauuucuauggacuaccuaagguagccuacauugauuugcaaaagaaucacauugcaauaauucaagaccaaacauucaaauuccuggaaaaauuacagaccuuggaucuccgagacaaugcucuuacaaccauucauuuuauuccaagcauacccgauaucuucuugaguggcaauaaacuagugacuuugccaaagaucaaccuuacagcgaaccucauccacuuaucagaaaacaggcuagaaaaucuagauauucucuacuuucuccuacggguaccucaucuccagauucucauuuuaaaucaaaaucgcuucuccuccuguaguggagaucaaaccccuucagagaaucccagcuuagaacagcuuuuccuuggagaaaauauguugcaacuugccugggaaacugagcucuguugggauguuuuugagggacuuucucaucuucaaguucuguauuugaaucauaacuaucuuaauucccuuccaccaggaguauuuagccaucugacugcauuaaggggacuaagccucaacuccaacaggcugacaguucuuucucacaaugauuuaccugcuaauuuagagauccuggacauauccaggaaccagcuccuagcuccuaauccugauguauuuguaucacuuagugucuuggauauaacucauaacaaguucauuugugaaugugaacuuagcacuuuuaucaauuggcuuaaucacaccaaugucacuauagcugggccuccugcagacauauauuguguguacccugacucgcucucugggguuucccucuucucucuuuccacggaagguugugaugaagaggaagucuuaaagucccuaaaguucucccuuuucauuguaugcacugucacucugacucuguuccucaugaccauccucacagucacaaaguuccggggcuucuguuuuaucuguuauaagacagcccagagacugguguucaaggaccauccccagggcacagaaccugauauguacaaauaugaugccuauuugugcuucagcagcaaagacuucacaugggugcagaaugcuuugcucaaacaccuggacacucaauacagugaccaaaacagauucaaccugugcuuugaagaaagagacuuugucccaggagaaaaccgcauugccaauauccaggaugccaucuggaacaguagaaagaucguuugucuugugagcagacacuuccuuagagauggcuggugccuugaagccuucaguuaugcccagggcaggugcuuaucugaccuuaacagugcucucaucaugguggugguuggguccuugucccaguaccaguugaugaaacaucaauccaucagaggcuuuguacagaaacagcaguauuugagguggccugaggaucuccaggauguuggcugguuucuucauaaacucucucaacagauacuaaagaaagaaaaagaaaagaagaaagacaauaacauuccguugcaaacuguagcaaccaucuccuaa

SEQ ID NO: 9636 - RNA, 2577 nt, Artificial Sequence
  derived and/or modified sequence opt1 from TLR5__Homo_sapiens__AAZ17468
augggcgaccaccuggaccuccugcugggggugguccucauggccggccccguguucgggaucccgagcugcuccuucgacggccgcaucgccuucuaccgguucugcaaccugacccaggugccccagguccugaacaccacggagcgccuccugcugagcuucaacuacauccggaccgugaccgcguccagcuuccccuuccucgagcagcugcagcugcucgagcuggggucccaguacacgccccugaccaucgacaaggaggccuuccgcaaccucccgaaccugcggauccuggaccucggcagcuccaagaucuacuuccugcaccccgacgccuuccagggccuguuccaccucuucgagcugcgccuguacuucugcgggcucagcgacgccgugcugaaggacggcuacuuccggaaccugaaggcccucacccgccuggaccuguccaagaaccagauccggagccucuaccugcaccccuccuucgggaagcugaacagccucaaguccaucgacuucagcuccaaccagaucuuccuggucugcgagcacgagcuggagccccuccagggcaagacccugagcuucuucucccuggcggccaacagccucuacucccgcgugagcguggacugggggaagugcaugaacccguuccggaacaugguccuggagauccuggacgugagcggcaacggcuggaccguggacaucacggggaacuucuccaacgccaucagcaagucccaggccuucagccucauccuggcgcaccacaucaugggcgccggguucggcuuccacaacaucaaggaccccgaccagaacaccuucgccggccuggcccgcuccagcguccggcaccucgaccugucccacggguucguguucagccugaacucccgcguguucgagacccucaaggaccugaagguccugaaccuggccuacaacaagaucaacaagaucgcggacgaggccuucuacggccucgacaaccuccaggugcugaaccugagcuacaaccugcugggggagcucuacuccagcaacuucuacggccugcccaagguggccuacaucgaccugcagaagaaccacaucgccaucauccaggaccagaccuucaaguuccucgagaagcugcagacgcuggaccuccgggacaacgcccugaccaccauccacuucauccccuccaucccggacaucuuccugagcgggaacaagcucgucacccugcccaagaucaaccugacggcgaaccucauccaccuguccgagaaccgccuggagaaccucgacauccuguacuuccugcuccgggugccccaccuccagauccugauccugaaccagaaccgcuucagcuccugcagcggcgaccagacccccuccgagaacccgagccuggagcagcuguuccucggcgagaacaugcugcagcuggccugggagaccgagcucugcugggacguguucgaggggcugagccaccuccagguccuguaccugaaccacaacuaccugaacucccucccgcccggcguguucagccaccugaccgcccugcgggggcucucccugaacagcaaccgccugacggugcucucccacaacgaccugcccgccaaccuggagauccucgacaucagccggaaccagcugcuggcccccaaccccgacgucuucgugucccucagcguccuggacaucacccacaacaaguucaucugcgagugcgagcuguccaccuucaucaacuggcucaaccacaccaacgugacgaucgcgggcccgcccgccgacaucuacugcguguaccccgacagccuguccggggucagccuguucucccucagcaccgagggcugcgacgaggaggaggugcugaagucccugaaguucagccucuucaucgugugcaccgucacccugacgcuguuccucaugaccauccugaccgugaccaaguuccgcggcuucugcuucaucugcuacaagacggcccagcgccugguguucaaggaccacccccaggggaccgagcccgacauguacaaguacgacgccuaccucugcuucuccagcaaggacuucaccuggguccagaacgcccugcugaagcaccucgacacccaguacagcgaccagaaccgguucaaccugugcuucgaggagcgcgacuucgugcccggcgagaaccggaucgcgaacauccaggacgccaucuggaacucccgcaagaucgugugccuggucagccggcacuuccuccgcgacggguggugccuggaggccuucuccuacgcccagggccggugccugagcgaccucaacuccgcgcugaucauggugguggucgggagccugucccaguaccagcucaugaagcaccagagcauccgcggcuucgugcagaagcagcaguaccugcgguggccggaggaccugcaggacgugggcugguuccuccacaagcugucccagcagauccugaagaaggagaaggagaagaagaaggacaacaacaucccccuccagacggucgccaccaucagcuga

SEQ ID NO: 9637 - RNA, 2577 nt, Artificial Sequence
  derived and/or modified sequence opt2 from TLR5__Homo_sapiens__AAZ17468
augggcgaccaccucgaccuccuccucggcgucguccucauggccggccccgucuucggcauccccuccugcuccuucgacggccgcaucgccuucuaccgcuucugcaaccucacccaggucccccagguccucaacaccaccgagcgccuccuccucuccuucaacuacauccgcaccgucaccgccuccuccuuccccuuccucgagcagcuccagcuccucgagcucggcucccaguacaccccccucaccaucgacaaggaggccuuccgcaaccuccccaaccuccgcauccucgaccucggcuccuccaagaucuacuuccuccaccccgacgccuuccagggccucuuccaccucuucgagcuccgccucuacuucugcggccucuccgacgccguccucaaggacggcuacuuccgcaaccucaaggcccucacccgccucgaccucuccaagaaccagauccgcucccucuaccuccaccccuccuucggcaagcucaacucccucaaguccaucgacuucuccuccaaccagaucuuccucgucugcgagcacgagcucgagccccuccagggcaagacccucuccuucuucucccucgccgccaacucccucuacucccgcgucuccgucgacuggggcaagugcaugaaccccuuccgcaacaugguccucgagauccucgacgucuccggcaacggcuggaccgucgacaucaccggcaacuucuccaacgccaucuccaagucccaggccuucucccucauccucgcccaccacaucaugggcgccggcuucggcuuccacaacaucaaggaccccgaccagaacaccuucgccggccucgcccgcuccuccguccgccaccucgaccucucccacggcuucgucuucucccucaacucccgcgucuucgagacccucaaggaccucaagguccucaaccucgccuacaacaagaucaacaagaucgccgacgaggccuucuacggccucgacaaccuccagguccucaaccucuccuacaaccuccucggcgagcucuacuccuccaacuucuacggccuccccaaggucgccuacaucgaccuccagaagaaccacaucgccaucauccaggaccagaccuucaaguuccucgagaagcuccagacccucgaccuccgcgacaacgcccucaccaccauccacuucauccccuccauccccgacaucuuccucuccggcaacaagcucgucacccuccccaagaucaaccucaccgccaaccucauccaccucuccgagaaccgccucgagaaccucgacauccucuacuuccuccuccgcgucccccaccuccagauccucauccucaaccagaaccgcuucuccuccugcuccggcgaccagacccccuccgagaaccccucccucgagcagcucuuccucggcgagaacaugcuccagcucgccugggagaccgagcucugcugggacgucuucgagggccucucccaccuccagguccucuaccucaaccacaacuaccucaacucccucccccccggcgucuucucccaccucaccgcccuccgcggccucucccucaacuccaaccgccucaccguccucucccacaacgaccuccccgccaaccucgagauccucgacaucucccgcaaccagcuccucgcccccaaccccgacgucuucgucucccucuccguccucgacaucacccacaacaaguucaucugcgagugcgagcucuccaccuucaucaacuggcucaaccacaccaacgucaccaucgccggcccccccgccgacaucuacugcgucuaccccgacucccucuccggcgucucccucuucucccucuccaccgagggcugcgacgaggaggagguccucaagucccucaaguucucccucuucaucgucugcaccgucacccucacccucuuccucaugaccauccucaccgucaccaaguuccgcggcuucugcuucaucugcuacaagaccgcccagcgccucgucuucaaggaccacccccagggcaccgagcccgacauguacaaguacgacgccuaccucugcuucuccuccaaggacuucaccuggguccagaacgcccuccucaagcaccucgacacccaguacuccgaccagaaccgcuucaaccucugcuucgaggagcgcgacuucguccccggcgagaaccgcaucgccaacauccaggacgccaucuggaacucccgcaagaucgucugccucgucucccgccacuuccuccgcgacggcuggugccucgaggccuucuccuacgcccagggccgcugccucuccgaccucaacuccgcccucaucauggucgucgucggcucccucucccaguaccagcucaugaagcaccaguccauccgcggcuucguccagaagcagcaguaccuccgcuggcccgaggaccuccaggacgucggcugguuccuccacaagcucucccagcagauccucaagaaggagaaggagaagaagaaggacaacaacaucccccuccagaccgucgccaccaucuccuga

SEQ ID NO: 9638 - RNA, 2577 nt, Artificial Sequence
  derived and/or modified sequence opt3 from TLR5__Homo_sapiens__AAZ17468
augggcgaccaccuggaucuccuucuggggguggucuugauggccggacccguuuucgguaucccuagcugcuccuuugacggcagaauugcuuucuacagguuuuguaacuuaacccaggugccacaaguacugaauacaacugagcggcuacuccugucuuucaacuauauacgcacggugaccgcaucaaguuuuccguuccuugaacagcugcaguugcucgagcuggggagccaguacacaccccugacuaucgauaaggaagccuuucgaaaucucccuaacuuacguauucuggaccuuggauccucuaaaaucuauuucuugcauccagaugcguuucaaggccuguuccaccuauuugagcucagacuguacuucugcggucuuucggacgcuguccugaaggauggguauuuuaggaauuugaaagcccucacccggcuggacuuaucaaagaaccagauucgcagccuguaccuccaucccaguuucggaaaacuuaauucccugaagucuaucgauuucagcuccaaccagauauuuuuggugugugaacacgagcuagagccucugcagggcaagacacucucauucuuuagucuggcagccaauagccuuuauucuagaguuuccguggacuggggcaaaugcaugaacccauucaggaauaugguccuggaaaucuuggaugugucagggaacggauggaccguagacauuacugguaauuuuagcaacgcuaucaguaagucucaagcauucucccucauucuggcccaucacaucaugggcgcuggguuuggauuccacaauauaaaagaucccgaccagaacacauuugccggcuuagcgcggagcucgguucgccaucuggaccuaucucacgguuucguguuuucccucaacucacgagucuucgagacccugaaggaucuuaaaguguugaaucuggcauacaacaagauuaauaagaucgccgacgaggcuuuuuacgggcucgauaaccugcaagugcuuaaucugaguuauaacuugcucggagaacuguacagcuccaauuucuauggcuuaccuaaagucgccuacauugaccugcagaagaaccauaucgcaaucauucaggaucagacguucaaauuucuagagaagcuccagacucuggaccuuagagauaaugcuuugaccacaauacacuucaucccaucuauuccggacaucuuucugagcggcaacaaacucguuacucugcccaagauaaauuuaaccgccaaccugauucaccuuucagaaaauagguuggagaaccucgauauccuguauuuccuacugcgggugccucaucuccaaauccugauucuuaaucagaaccguuuuaguuccuguagcggggaccagacaccaucugaaaaccccucauuggagcagcuguucuuaggagaaaauaugcuccaacuggcgugggagaccgagcuuugcugggauguauuugaaggucugagucaccuccagguguuguaccugaaccauaauuaucuaaacagccugccuccaggcgucuucucccaccucacggcccugcgcgggcuuucuuugaacucgaauagacugacuguguuaagccauaaugaccuccccgcaaaccuggagauccuugacauuuccaggaaucagcugcuagcuccgaacccugauguuuuugugucacucaguguccuggacauaacacacaauaaauucaucugugaaugcgaguugucuaccuuuauuaacuggcugaaucacacuaacgugacaaucgccggacccccagcugauaucuacuguguauacccugacagcuuauccggcguuucacucuucagccugucuaccgaagguugcgaugaggaggaagugcuuaagucccugaaguuuaguuuguucauugucuguacggugacccucacacuguuccuaaugacuauacugaccgucacaaaauuucggggguucugcuuuaucugcuauaagacugcccagcgacuuguguucaaagaccauccccaaggcaccgagccagauauguacaaguaugacgcauaccucuguuuuagcucuaaagauuucacauggguucagaaugcccuguugaagcaccuggacacccaguauuccgaucagaaccgcuuuaacuuaugcuucgaagagagagacuuugugcccggagaaaauaggauugcuaacauccaagaugcgauuuggaauagucggaagaucguaugucucgucucacgccauuuccugagagacggcuggugccuugaggcauuuagcuacgcccaggggaggugucugucggacuugaacuccgcucucauaauggugguugugggaucucugagccaguaucagcuaaugaaacaccaaucaauccgugguuucguccagaagcagcaauaccugcgguggccugaggaucuucaggacgugggcugguuccuccacaaacugagucagcagauuuugaagaaagaaaaggagaagaaaaaggauaauaacaucccauuacaaacuguagccacgauuuccuga

SEQ ID NO: 9639 - RNA, 2577 nt, Artificial Sequence
  derived and/or modified sequence opt4 from TLR5__Homo_sapiens__AAZ17468
augggcgaccaccuggaccugcugcugggcguggugcugauggccggccccguguucggcauccccagcugcagcuucgacggcagaaucgccuucuacagauucugcaaccugacccaggugccccaggugcugaacaccaccgagagacugcugcugagcuucaacuacaucagaaccgugaccgccagcagcuuccccuuccuggagcagcugcagcugcuggagcugggcagccaguacaccccccugaccaucgacaaggaggccuucagaaaccugcccaaccugagaauccuggaccugggcagcagcaagaucuacuuccugcaccccgacgccuuccagggccuguuccaccuguucgagcugagacuguacuucugcggccugagcgacgccgugcugaaggacggcuacuucagaaaccugaaggcccugaccagacuggaccugagcaagaaccagaucagaagccuguaccugcaccccagcuucggcaagcugaacagccugaagagcaucgacuucagcagcaaccagaucuuccuggugugcgagcacgagcuggagccccugcagggcaagacccugagcuucuucagccuggccgccaacagccuguacagcagagugagcguggacuggggcaagugcaugaaccccuucagaaacauggugcuggagauccuggacgugagcggcaacggcuggaccguggacaucaccggcaacuucagcaacgccaucagcaagagccaggccuucagccugauccuggcccaccacaucaugggcgccggcuucggcuuccacaacaucaaggaccccgaccagaacaccuucgccggccuggccagaagcagcgugagacaccuggaccugagccacggcuucguguucagccugaacagcagaguguucgagacccugaaggaccugaaggugcugaaccuggccuacaacaagaucaacaagaucgccgacgaggccuucuacggccuggacaaccugcaggugcugaaccugagcuacaaccugcugggcgagcuguacagcagcaacuucuacggccugcccaagguggccuacaucgaccugcagaagaaccacaucgccaucauccaggaccagaccuucaaguuccuggagaagcugcagacccuggaccugagagacaacgcccugaccaccauccacuucauccccagcauccccgacaucuuccugagcggcaacaagcuggugacccugcccaagaucaaccugaccgccaaccugauccaccugagcgagaacagacuggagaaccuggacauccuguacuuccugcugagagugccccaccugcagauccugauccugaaccagaacagauucagcagcugcagcggcgaccagacccccagcgagaaccccagccuggagcagcuguuccugggcgagaacaugcugcagcuggccugggagaccgagcugugcugggacguguucgagggccugagccaccugcaggugcuguaccugaaccacaacuaccugaacagccugccccccggcguguucagccaccugaccgcccugagaggccugagccugaacagcaacagacugaccgugcugagccacaacgaccugcccgccaaccuggagauccuggacaucagcagaaaccagcugcuggcccccaaccccgacguguucgugagccugagcgugcuggacaucacccacaacaaguucaucugcgagugcgagcugagcaccuucaucaacuggcugaaccacaccaacgugaccaucgccggcccccccgccgacaucuacugcguguaccccgacagccugagcggcgugagccuguucagccugagcaccgagggcugcgacgaggaggaggugcugaagagccugaaguucagccuguucaucgugugcaccgugacccugacccuguuccugaugaccauccugaccgugaccaaguucagaggcuucugcuucaucugcuacaagaccgcccagagacugguguucaaggaccacccccagggcaccgagcccgacauguacaaguacgacgccuaccugugcuucagcagcaaggacuucaccugggugcagaacgcccugcugaagcaccuggacacccaguacagcgaccagaacagauucaaccugugcuucgaggagagagacuucgugcccggcgagaacagaaucgccaacauccaggacgccaucuggaacagcagaaagaucgugugccuggugagcagacacuuccugagagacggcuggugccuggaggccuucagcuacgcccagggcagaugccugagcgaccugaacagcgcccugaucauggugguggugggcagccugagccaguaccagcugaugaagcaccagagcaucagaggcuucgugcagaagcagcaguaccugagauggcccgaggaccugcaggacgugggcugguuccugcacaagcugagccagcagauccugaagaaggagaaggagaagaagaaggacaacaacaucccccugcagaccguggccaccaucagcuga

SEQ ID NO: 9640 - RNA, 2577 nt, Artificial Sequence
  derived and/or modified sequence opt5 from TLR5__Homo_sapiens__AAZ17468
augggcgaccaccuggaucuccugcuuggggugguccugauggccggacccguuuucggcaucccuagcugcuccuuugacgggagaauugcuuucuaccgguuuuguaaccucacccaggugccgcaagugcugaauacaacggagcgccuucugcucucuuucaacuauaucagaaccgucacagccagcuccuuucccuuccuggaacagcugcagcuccuggagcuuggaucucaguacaccccucugacaauugauaaggaagcguuucggaaucuccccaaccugcgcauccuugaccugggcagcuccaaaauuuauuuccuccauccugaugcuuuucaagggcuguuccaccuguuugagcucagacuguacuucugcggacuuucugacgccgugcugaaggauggcuauuuucggaaucucaaagcccugacccgccuugaccugagcaagaaccagaucagaucccucuaccugcaucccagcuucggcaaacucaauucucucaaguccaucgauuucagcucuaaccagauuuuucugguuugugaacacgagcuugagccucugcaggggaagacacucuccuucuuuagccuggcugccaauucucuuuauucccgggugagcgucgacuggggaaaaugcaugaacccguuccgcaauauggugcuggaaauccucgauguuuccggcaacggguggaccguggacauuacgggaaauuuuucuaacgcuaucagcaagucccaagccuucagccugauucuggcgcaucacaucaugggcgccggguuuggauuccacaauauuaaagaucccgaccagaacaccuuugcuggccucgccagaucuuccguccggcaucuggaccuuagccacggcuucguguuuucucugaacagccgcguguucgagacacucaaggaucugaaaguccugaaucuugcuuacaacaagaucaauaagaucgccgacgaagcguuuuacgggcucgauaaccugcagguucugaaucucuccuauaaccugcuuggagagcuguacucuagcaauuucuauggccucccuaaaguggccuacauugaccugcagaagaaccauaucgcuauuauccaagaucagaccuucaaauuucuggagaagcugcagacacucgaccugagagauaaugcccugaccacgauucacuucauccccuccaucccugacauuuuucucagcgggaacaaacuggugacacuucccaagaucaaucugaccgcuaaccucauucaccugucugaaaaucggcuggagaaccuugauauccucuauuuccugcugcgcgucccgcaucuccaaauucugauccuuaaucagaacagauuuuccagcuguucuggagaccagacaccuuccgaaaaccccagccuggagcagcuguuccugggcgaaaauaugcugcaacuugccugggagaccgagcucugcugggauguguuugaagggcugucccaccuucagguucucuaccugaaccauaauuaucuuaacucucugccucccggaguguucagccaccucaccgcccugcggggccugucccuuaauucuaacagacugacaguccucagccauaaugaccugcccgcuaaccucgagauccuggacauuucccgcaaucagcuucuggcgccuaacccggauguguuuguuagccucucugugcuggacaucacgcacaauaaauucauuugugaaugcgagcuguccaccuuuaucaacuggcuuaaucacacaaacgucaccauugccgggcccccugcugauaucuacuguguguaccccgacagccugucuggcgucucccucuucagccugucuacagaaggaugcgaugaggaggaagugcucaagagccugaaguuuucccuuuucauuguuuguaccgugacgcugacacucuuccugaugaccauccugaccgucacaaaauuucggggcuucugcuuuaucugcuauaagaccgcccagagacuuguguucaaagaccauccucaagggacagagcccgauauguacaaguaugacgccuaccuguguuuuagcucuaaagauuucacguggguucagaaugcucuccugaagcaccucgacacccaguauuccgaucagaaccgcuuuaaccugugcuucgaggaacgggacuuugugccgggagaaaauagaauugccaacauccaagaugcgauuuggaauagccgcaagaucgucugucuugugucccggcauuuccugagagacggcuggugccuggaggcuuuuucuuacgcccaggggcgcugucucagcgaccugaacuccgcccuuauuauggugguugucggcucucugagccaguaucagcucaugaaacaccaauccauccggggauucgugcagaagcagcaauaccugagauggccugaggaucuccaggacgugggcugguuccugcacaaacuuucucagcagauccugaagaaagaaaaggagaagaaaaaggauaauaacauuccccugcaaacagucgcuaccaucagcuga

SEQ ID NO: 9641 - protein, 858 aa, Artificial Sequence [sequence omitted]

SEQ ID NO: 9642 - RNA, 2577 nt, Artificial Sequence
  TLR5__Homo_sapiens__AAZ17470
augggagaccaccuggaccuucuccuaggaguggugcucauggccgguccuguguuuggaauuccuuccugcuccuuugauggccgaauagccuuuuaucguuucugcaaccucacccaggucccccagguccucaacaccacugagaggcuccugcugagcuucaacuauaucaggacagucacugcuucauccuuccccuuucuggaacagcugcagcugcuggagcucgggagccaguauacccccuugacuauugacaaggaggccuucagaaaccugcccaaccuuagaaucuuggaccugggaaguaguaagauauacuucuugcauccagaugcuuuucagggacuguuccaucuguuugaacuuagacuguauuucuguggucucucugaugcuguauugaaagaugguuauuucagaacuuuaaaggcuuuaacucgcuuggaucuauccaaaaaucagauucguagccuuuaccuucauccuucauuugggaaguugaauuccuuaaaguccauagauuuuuccuccaaccaaauauuccuuguaugugaacaugagcucgagccccuacaagggaaaacgcucuccuuuuuuagccucgcagcuaauagcuuguauagcagagucucaguggacuggggaaaauguaugaacccauucagaaacauggugcuggagauacuagauguuucuggaaauggcuggacaguggacaucacaggaaacuuuagcaaugccaucagcaaaagccaggccuucucuuugauucuugcccaccacaucaugggugccggguuuggcuuccauaacaucaaagauccugaccagaacacauuugcuggccuggccagaaguucagugagacaccuggaucuuucacauggguuugucuucucccugaacucacgagucuuugagacacucaaggauuugaagguucugaaccuugccuacaacaagauaaauaagauugcagaugaagcauuuuacggacuugacaaccuccaaguucucaauuugucauauaaccuucugggggaacuuuacaguucgaauuucuauggacuaccuaagguagccuacauugauuugcaaaagaaucacauugcaauaauucaagaccaaacauucaaauuccuggaaaaauuacagaccuuggaucuccgagacaaugcucuuacaaccauucauuuuauuccaagcauacccgauaucuucuugaguggcaauaaacuagugacuuugccaaagaucaaccuuacagcgaaccucauccacuuaucagaaaacaggcuagaaaaucuagauauucucuacuuucuccuacggguaccucaucuccagauucucauuuuaaaucaaaaucgcuucuccuccuguaguggagaucaaaccccuucagagaaucccagcuuagaacagcuuuuccuuggagaaaauauguugcaacuugccugggaaacugagcucuguugggauguuuuugagggacuuucucaucuucaaguucuguauuugaaucauaacuaucuuaauucccuuccaccaggaguauuuagccaucugacugcauuaaggggacuaagccucaacuccaacaggcugacaguucuuucucacaaugauuuaccugcuaauuuagagauccuggacauauccaggaaccagcuccuagcuccuaauccugauguauuuguaucacuuagugucuuggauauaacucauaacaaguucauuugugaaugugaacuuagcacuuuuaucaauuggcuuaaucacaccaaugucacuauagcugggccuccugcagacauauauuguguguacccugacucguucucugggguuucccucuucucucuuuccacggaagguugugaugaagaggaagucuuaaagucccuaaaguucucccuuuucuuuguaugcacugucacucugacucuguuccucaugaccauccucacagucacaaaguuccggggcuucuguuuuaucuguuauaagacagcccagagacugguguucaaggaccauccccagggcacagaaccugauauguacaaauaugaugccuauuugugcuucagcagcaaagacuucacaugggugcagaaugcuuugcucaaacaccuggacacucaauacagugaccaaaacagauucaaccugugcuuugaagaaagagacuuugucccaggagaaaaccgcauugccaauauccaggaugccaucuggaacaguagaaagaucguuugucuugugagcagacacuuccuuagagauggcuggugccuugaagccuucaguuaugcccagggcaggugcuuaucugaccuuaacagugcucucaucaugguggugguuggguccuugucccaguaccaguugaugaaacaucaauccaucagaggcuuuguacagaaacagcaguauuugagguggccugaggaucuccaggauguuggcugguuucuucauaaacucucucaacagauacuaaagaaagaaaaagaaaagaagaaagacaauaacauuccguugcaaacuguagcaaccaucuccuaa

SEQ ID NO: 9643 - RNA, 2577 nt, Artificial Sequence
  derived and/or modified sequence opt1 from TLR5__Homo_sapiens__AAZ17470
augggcgaccaccuggaccuccugcugggggugguccucauggccggccccguguucgggaucccgagcugcuccuucgacggccgcaucgccuucuaccgguucugcaaccugacccaggugccccagguccugaacaccacggagcgccuccugcugagcuucaacuacauccggaccgugaccgcguccagcuuccccuuccucgagcagcugcagcugcucgagcuggggucccaguacacgccccugaccaucgacaaggaggccuuccgcaaccucccgaaccugcggauccuggaccucggcagcuccaagaucuacuuccugcaccccgacgccuuccagggccuguuccaccucuucgagcugcgccuguacuucugcgggcucagcgacgccgugcugaaggacggcuacuuccggacccugaaggcccucacccgccuggaccuguccaagaaccagauccggagccucuaccugcaccccuccuucgggaagcugaacagccucaaguccaucgacuucagcuccaaccagaucuuccuggucugcgagcacgagcuggagccccuccagggcaagacccugagcuucuucucccuggcggccaacagccucuacucccgcgugagcguggacugggggaagugcaugaacccguuccggaacaugguccuggagauccuggacgugagcggcaacggcuggacgguggacaucaccgggaacuucuccaacgccaucagcaagucccaggccuucagccucauccuggcgcaccacaucaugggcgccggguucggcuuccacaacaucaaggaccccgaccagaacaccuucgccggccuggcccgcuccagcguccggcaccucgaccugucccacggguucguguucagccugaacucccgcguguucgagacccucaaggaccugaagguccugaaccuggccuacaacaagaucaacaagaucgcggacgaggccuucuacggccucgacaaccuccaggugcugaaccugagcuacaaccugcugggggagcucuacuccagcaacuucuacggccugcccaagguggccuacaucgaccugcagaagaaccacaucgccaucauccaggaccagacguucaaguuccucgagaagcugcagacccuggaccuccgggacaacgcccugaccaccauccacuucauccccuccaucccggacaucuuccugagcgggaacaagcucgucacgcugcccaagaucaaccugaccgcgaaccucauccaccuguccgagaaccgccuggagaaccucgacauccuguacuuccugcuccgggugccccaccuccagauccugauccugaaccagaaccgcuucagcuccugcagcggcgaccagacccccuccgagaacccgagccuggagcagcuguuccucggcgagaacaugcugcagcuggccugggagaccgagcucugcugggacguguucgaggggcugagccaccuccagguccuguaccugaaccacaacuaccugaacucccucccgcccggcguguucagccaccugacggcccugcgggggcucucccugaacagcaaccgccugaccgugcucucccacaacgaccugcccgccaaccuggagauccucgacaucagccggaaccagcugcuggcccccaaccccgacgucuucgugucccucagcguccuggacaucacccacaacaaguucaucugcgagugcgagcuguccaccuucaucaacuggcucaaccacacgaacgugaccaucgcgggcccgcccgccgacaucuacugcguguaccccgacagcuucuccggggucagccuguucucccugagcaccgagggcugcgacgaggaggaggugcucaagucccugaaguucagccuguucuucgugugcaccgucacgcucacccuguuccugaugaccauccucaccgugacgaaguuccgcggcuucugcuucaucugcuacaagaccgcccagcgccugguguucaaggaccacccccaggggaccgagcccgacauguacaaguacgacgccuaccugugcuucuccagcaaggacuucaccuggguccagaacgcccuccugaagcaccuggacacgcaguacagcgaccagaaccgguucaaccucugcuucgaggagcgcgacuucgugcccggcgagaaccggaucgcgaacauccaggacgccaucuggaacucccgcaagaucgugugccuggucagccggcacuuccugcgcgacggguggugccucgaggccuucuccuacgcccagggccggugccugagcgaccugaacuccgcgcucaucauggugguggucgggagccugucccaguaccagcugaugaagcaccagagcauccgcggcuucgugcagaagcagcaguaccuccgguggccggaggaccugcaggacgugggcugguuccugcacaagcucucccagcagauccugaagaaggagaaggagaagaagaaggacaacaacaucccccugcagaccgucgccaccaucagcuga

SEQ ID NO: 9644 - RNA, 2577 nt, Artificial Sequence
  derived and/or modified sequence opt2 from TLR5__Homo_sapiens__AAZ17470
augggcgaccaccucgaccuccuccucggcgucguccucauggccggccccgucuucggcauccccuccugcuccuucgacggccgcaucgccuucuaccgcuucugcaaccucacccaggucccccagguccucaacaccaccgagcgccuccuccucuccuucaacuacauccgcaccgucaccgccuccuccuuccccuuccucgagcagcuccagcuccucgagcucggcucccaguacaccccccucaccaucgacaaggaggccuuccgcaaccuccccaaccuccgcauccucgaccucggcuccuccaagaucuacuuccuccaccccgacgccuuccagggccucuuccaccucuucgagcuccgccucuacuucugcggccucuccgacgccguccucaaggacggcuacuuccgcacccucaaggcccucacccgccucgaccucuccaagaaccagauccgcucccucuaccuccaccccuccuucggcaagcucaacucccucaaguccaucgacuucuccuccaaccagaucuuccucgucugcgagcacgagcucgagccccuccagggcaagacccucuccuucuucucccucgccgccaacucccucuacucccgcgucuccgucgacuggggcaagugcaugaaccccuuccgcaacaugguccucgagauccucgacgucuccggcaacggcuggaccgucgacaucaccggcaacuucuccaacgccaucuccaagucccaggccuucucccucauccucgcccaccacaucaugggcgccggcuucggcuuccacaacaucaaggaccccgaccagaacaccuucgccggccucgcccgcuccuccguccgccaccucgaccucucccacggcuucgucuucucccucaacucccgcgucuucgagacccucaaggaccucaagguccucaaccucgccuacaacaagaucaacaagaucgccgacgaggccuucuacggccucgacaaccuccagguccucaaccucuccuacaaccuccucggcgagcucuacuccuccaacuucuacggccuccccaaggucgccuacaucgaccuccagaagaaccacaucgccaucauccaggaccagaccuucaaguuccucgagaagcuccagacccucgaccuccgcgacaacgcccucaccaccauccacuucauccccuccauccccgacaucuuccucuccggcaacaagcucgucacccuccccaagaucaaccucaccgccaaccucauccaccucuccgagaaccgccucgagaaccucgacauccucuacuuccuccuccgcgucccccaccuccagauccucauccucaaccagaaccgcuucuccuccugcuccggcgaccagacccccuccgagaaccccucccucgagcagcucuuccucggcgagaacaugcuccagcucgccugggagaccgagcucugcugggacgucuucgagggccucucccaccuccagguccucuaccucaaccacaacuaccucaacucccucccccccggcgucuucucccaccucaccgcccuccgcggccucucccucaacuccaaccgccucaccguccucucccacaacgaccuccccgccaaccucgagauccucgacaucucccgcaaccagcuccucgcccccaaccccgacgucuucgucucccucuccguccucgacaucacccacaacaaguucaucugcgagugcgagcucuccaccuucaucaacuggcucaaccacaccaacgucaccaucgccggcccccccgccgacaucuacugcgucuaccccgacuccuucuccggcgucucccucuucucccucuccaccgagggcugcgacgaggaggagguccucaagucccucaaguucucccucuucuucgucugcaccgucacccucacccucuuccucaugaccauccucaccgucaccaaguuccgcggcuucugcuucaucugcuacaagaccgcccagcgccucgucuucaaggaccacccccagggcaccgagcccgacauguacaaguacgacgccuaccucugcuucuccuccaaggacuucaccuggguccagaacgcccuccucaagcaccucgacacccaguacuccgaccagaaccgcuucaaccucugcuucgaggagcgcgacuucguccccggcgagaaccgcaucgccaacauccaggacgccaucuggaacucccgcaagaucgucugccucgucucccgccacuuccuccgcgacggcuggugccucgaggccuucuccuacgcccagggccgcugccucuccgaccucaacuccgcccucaucauggucgucgucggcucccucucccaguaccagcucaugaagcaccaguccauccgcggcuucguccagaagcagcaguaccuccgcuggcccgaggaccuccaggacgucggcugguuccuccacaagcucucccagcagauccucaagaaggagaaggagaagaagaaggacaacaacaucccccuccagaccgucgccaccaucuccuga

SEQ ID NO: 9645 - RNA, 2577 nt, Artificial Sequence
  derived and/or modified sequence opt3 from TLR5__Homo_sapiens__AAZ17470
augggcgaccaccuggaucuccuucuggggguggucuugauggccggacccguuuucgguaucccuagcugcuccuuugacggcagaauugcuuucuacagguuuuguaacuuaacccaggugccacaaguacugaauacaacugagcggcuacuccugucuuucaacuauauacgcacggugaccgcaucaaguuuuccguuccuugaacagcugcaguugcucgagcuggggagccaguacacaccccugacuaucgauaaggaagccuuucgaaaucucccuaacuuacguauucuggaccuuggauccucuaaaaucuauuucuugcauccagaugcguuucaaggccuguuccaccuauuugagcucagacuguacuucugcggucuuucggacgcuguccugaaggauggguauuuuaggaccuugaaagcccucacacggcuggacuuaucaaagaaucagauucgcagccuguaccuccaucccaguuucggaaaacuuaacucccugaagucuaucgauuucagcuccaaucagauauuuuuggugugugaacacgagcuagagccucugcagggcaagacccucucauucuuuagucuggcagccaacagccuuuauucuagaguuuccguggacuggggcaaaugcaugaauccauucaggaacaugguccuggaaaucuuggaugugucagggaauggauggacuguagacauuacagguaacuuuagcaaugcuaucaguaagucucaagcauucucccucauucuggcccaucacaucaugggcgcuggguuuggauuccacaacauaaaagaucccgaccagaauaccuuugccggcuuagcgcggagcucgguucgccaucuggaccuaucucacgguuucguguuuucccucaacucacgagucuucgagacgcugaaggaucuuaaaguguugaaccuggcauacaauaagauuaacaagaucgccgacgaggcuuuuuacgggcucgauaaucugcaagugcuuaaccugaguuauaauuugcucggagaacuguacagcuccaacuucuauggcuuaccuaaagucgccuacauugaccugcagaagaaucauaucgcaaucauucaggaucagacuuucaaauuucuagagaagcuccagacccuggaccuuagagauaacgcuuugacaacuauacacuucaucccaucuauuccggacaucuuucugagcggcaauaaacucguuacccugcccaagauaaacuuaacagccaaucugauucaccuuucagaaaacagguuggagaaucucgauauccuguauuuccuacugcgggugccucaucuccaaauccugauucuuaaccagaaucguuuuaguuccuguagcggggaccagaccccaucugaaaaccccucauuggagcagcuguucuuaggagaaaacaugcuccaacuggcgugggagacggagcuuugcugggauguauuugaaggucugagucaccuccagguguuguaccugaaucauaacuaucuaaauagccugccuccaggcgucuucucccaccucacugcccugcgcgggcuuucuuugaacucgaauagacugacaguguuaagccauaacgaccuccccgcaaaucuggagauccuugacauuuccaggaaccagcugcuagcuccgaauccugauguuuuugugucacucaguguccuggacauaacccacaacaaauucaucugugaaugcgaguugucuacuuuuauuaauuggcugaaccacacaaaugugaccaucgccggacccccagcugauaucuacuguguauacccugacagcuucuccggcguuucauuauuuagccucucuacggaagguugcgaugaggaggaagugcugaagucccuuaaguucagucuguucuuugucuguaccgugacauugacucucuuccugaugaccauucuaacagucacuaaauuucggggguucugcuuuauaugcuauaagaccgcccagcgacugguguucaaagaccauccccaaggcacagagccagauauguacaaguaugacgcauaccuuuguuuuagcucuaaagauuucaccuggguucagaacgcccuccugaagcacuuggacacucaguauuccgaucagaaucgcuuuaaccugugcuucgaagagagagacuuugugcccggagaaaacaggaucgcuaauauucaagaugcgaucuggaacucacggaagauuguauguuuagucagucgccauuuccucagagacggcuggugccuggaggcauucagcuacgcccaggggaggugucuuucggaccugaacuccgcuuugaucauggugguugugggaucucucagccaguaucagcugaugaaacaccaaucaauacgugguuuuguccagaagcagcaauaccuacgguggccugaggaucugcaggacgugggcugguuccuucacaaacucagucagcagauccugaagaaagaaaaggagaagaaaaaggauaauaauauuccauugcaaacgguagccacaaucuccuga

SEQ ID NO: 9646 - RNA, 2577 nt, Artificial Sequence
  derived and/or modified sequence opt4 from TLR5__Homo_sapiens__AAZ17470
augggcgaccaccuggaccugcugcugggcguggugcugauggccggccccguguucggcauccccagcugcagcuucgacggcagaaucgccuucuacagauucugcaaccugacccaggugccccaggugcugaacaccaccgagagacugcugcugagcuucaacuacaucagaaccgugaccgccagcagcuuccccuuccuggagcagcugcagcugcuggagcugggcagccaguacaccccccugaccaucgacaaggaggccuucagaaaccugcccaaccugagaauccuggaccugggcagcagcaagaucuacuuccugcaccccgacgccuuccagggccuguuccaccuguucgagcugagacuguacuucugcggccugagcgacgccgugcugaaggacggcuacuucagaacccugaaggcccugaccagacuggaccugagcaagaaccagaucagaagccuguaccugcaccccagcuucggcaagcugaacagccugaagagcaucgacuucagcagcaaccagaucuuccuggugugcgagcacgagcuggagccccugcagggcaagacccugagcuucuucagccuggccgccaacagccuguacagcagagugagcguggacuggggcaagugcaugaaccccuucagaaacauggugcuggagauccuggacgugagcggcaacggcuggaccguggacaucaccggcaacuucagcaacgccaucagcaagagccaggccuucagccugauccuggcccaccacaucaugggcgccggcuucggcuuccacaacaucaaggaccccgaccagaacaccuucgccggccuggccagaagcagcgugagacaccuggaccugagccacggcuucguguucagccugaacagcagaguguucgagacccugaaggaccugaaggugcugaaccuggccuacaacaagaucaacaagaucgccgacgaggccuucuacggccuggacaaccugcaggugcugaaccugagcuacaaccugcugggcgagcuguacagcagcaacuucuacggccugcccaagguggccuacaucgaccugcagaagaaccacaucgccaucauccaggaccagaccuucaaguuccuggagaagcugcagacccuggaccugagagacaacgcccugaccaccauccacuucauccccagcauccccgacaucuuccugagcggcaacaagcuggugacccugcccaagaucaaccugaccgccaaccugauccaccugagcgagaacagacuggagaaccuggacauccuguacuuccugcugagagugccccaccugcagauccugauccugaaccagaacagauucagcagcugcagcggcgaccagacccccagcgagaaccccagccuggagcagcuguuccugggcgagaacaugcugcagcuggccugggagaccgagcugugcugggacguguucgagggccugagccaccugcaggugcuguaccugaaccacaacuaccugaacagccugccccccggcguguucagccaccugaccgcccugagaggccugagccugaacagcaacagacugaccgugcugagccacaacgaccugcccgccaaccuggagauccuggacaucagcagaaaccagcugcuggcccccaaccccgacguguucgugagccugagcgugcuggacaucacccacaacaaguucaucugcgagugcgagcugagcaccuucaucaacuggcugaaccacaccaacgugaccaucgccggcccccccgccgacaucuacugcguguaccccgacagcuucagcggcgugagccuguucagccugagcaccgagggcugcgacgaggaggaggugcugaagagccugaaguucagccuguucuucgugugcaccgugacccugacccuguuccugaugaccauccugaccgugaccaaguucagaggcuucugcuucaucugcuacaagaccgcccagagacugguguucaaggaccacccccagggcaccgagcccgacauguacaaguacgacgccuaccugugcuucagcagcaaggacuucaccugggugcagaacgcccugcugaagcaccuggacacccaguacagcgaccagaacagauucaaccugugcuucgaggagagagacuucgugcccggcgagaacagaaucgccaacauccaggacgccaucuggaacagcagaaagaucgugugccuggugagcagacacuuccugagagacggcuggugccuggaggccuucagcuacgcccagggcagaugccugagcgaccugaacagcgcccugaucauggugguggugggcagccugagccaguaccagcugaugaagcaccagagcaucagaggcuucgugcagaagcagcaguaccugagauggcccgaggaccugcaggacgugggcugguuccugcacaagcugagccagcagauccugaagaaggagaaggagaagaagaaggacaacaacaucccccugcagaccguggccaccaucagcuga

SEQ ID NO: 9647 - RNA, 2577 nt, Artificial Sequence
  derived and/or modified sequence opt5 from TLR5__Homo_sapiens__AAZ17470
augggcgaccaccuggaucuccugcuuggggugguccugauggccggacccguuuucggcaucccuagcugcuccuuugacgggagaauugcuuucuaccgguuuuguaaccucacccaggugccgcaagugcugaauacaacggagcgccuucugcucucuuucaacuauaucagaaccgucacagccagcuccuuucccuuccuggaacagcugcagcuccuggagcuuggaucucaguacaccccucugacaauugauaaggaagcguuucggaaucuccccaaccugcgcauccuugaccugggcagcuccaaaauuuauuuccuccauccugaugcuuuucaagggcuguuccaccuguuugagcucagacuguacuucugcggacuuucugacgccgugcugaaggauggcuauuuucggacccucaaagcccugacacgccuugaccugagcaagaaucagaucagaucccucuaccugcaucccagcuucggcaaacugaacucucucaaguccaucgauuucagcucuaaucagauuuuucugguuugugaacacgagcuugagccucugcaggggaagacccucuccuucuuuagccuggcugccaacucucuuuauucccgggugagcgucgacuggggaaaaugcaugaauccguuccgcaacauggugcuggaaauccucgauguuuccggcaauggguggacgguggacauuaccggaaacuuuucuaaugcuaucagcaagucccaagccuucagccugauucuggcgcaucacaucaugggcgccggguuuggauuccacaacauuaaagaucccgaccagaauacauuugcuggccucgccagaucuuccguccggcaucuggaccuuagccacggcuucguguuuucucugaacagccgcguguucgagacccucaaggaucugaaaguccugaaccuugcuuacaauaagaucaacaagaucgccgacgaagcguuuuacgggcucgauaaucugcagguucugaaccucuccuauaaucugcuuggagagcuguacucuagcaacuucuauggccucccuaaaguggccuacauugaccugcagaagaaucauaucgcuauuauccaagaucagacauucaaauuucuggagaagcugcagacccucgaccugagagauaacgcccugacgacaauucacuucauccccuccaucccugacauuuuucucagcgggaauaaacuggugacccuucccaagaucaaccugacagcuaaucucauucaccugucugaaaaccggcuggagaaucuugauauccucuauuuccugcugcgcgucccgcaucuccaaauucugauccuuaaccagaauagauuuuccagcuguucuggagaccagaccccuuccgaaaaccccagccuggagcaacucuuccugggcgaaaacaugcugcagcuugccugggagaccgagcucugcugggauguguuugaagggcugucccaucugcagguucucuaccugaaucacaacuaucuuaauucucugccucccggaguguucagccaccucacagcccugcggggccugucccuuaacucuaauagacugacgguccucagccauaacgaccugcccgcuaaucucgagauccuggacauuucccgcaaccagcuucuggcgccuaauccggauguguuuguuagccucucugugcuggacaucacccacaacaaauucauuugugaaugcgagcuguccacauuuaucaauuggcuuaaccacaccaaugucacaauugccgggcccccugcugauaucuacuguguguaccccgacagcuucucuggcgucucccuguuuagccucucuaccgaaggaugcgaugaggaggaagugcuuaagagccucaaguucucccuguucuuuguuuguacggugacacuuacccuguuccucaugaccauucugacagucaccaaauuucggggcuucugcuuuaucugcuauaagacagcccagagacugguguucaaagaccauccucaagggacggagcccgauauguacaaguaugacgccuaccuuuguuuuagcucuaaagauuucaccuggguucagaacgcucugcucaagcaccuggacacacaguauuccgaucagaaucgcuuuaaccucugcuucgaggaacgggacuuugugccgggagaaaacagaaucgccaauauucaagaugcgaucuggaacagccgcaagauugucugucuggugucccggcauuuccuuagagacggcuggugccuggaggcuuucucuuacgcccaggggcgcugucugagcgaccucaauuccgcccugaucauggugguugucggcucucuuagccaguaucagcugaugaaacaccaauccauucggggauuugugcagaagcagcaauaccucagauggccugaggaucugcaggacgugggcugguuccuccacaaacugucucagcagauccuuaagaaagaaaaggagaagaaaaaggauaacaauaucccccugcaaaccgucgcuacaauuagcuga

SEQ ID NO: 9648 - protein, 858 aa, Artificial Sequence [sequence omitted]

SEQ ID NO: 9649 - RNA, 2577 nt, Artificial Sequence
  TLR5__Homo_sapiens__AAZ17471
augggagaccaccuggaccuucuccuaggaguggugcucauggccgguccuguguuuggaauuccuuccugcuccuuugauggccgaauagccuuuuaucguuucugcaaccucacccaggucccccagguccucaacaccacugagaggcuccugcugagcuucaacuauaucaggacagucacugcuucauccuuccccuuucuggaacagcugcagcugcuggagcucgggagccaguauacccccuugacuauugacaaggaggccuucagaaaccugcccaaccuuagaaucuuggaccugggaaguaguaagauauacuucuugcauccagaugcuuuucagggacuguuccaucuguuugaacuuagacuguauuucuguggucucucugaugcuguauugaaagaugguuauuucagaaauuuaaaggcuuuaacucgcuuggaucuauccaaaaaucagauucguagccuuuaccuucauccuucauuugggaaguugaauuccuuaaaguccauagauuuuuccuccaaccaaauauuccuuguaugugaacaugagcucgagccccuacaagggaaaacgcucuccuuuuuuagccucgcagcuaauagcuuguauagcagagucucaguggacuggggaaaauguaugaacccauucagaaacauggugcuggagauacuagauguuucuggaaauggcuggacaguggacaucacaggaaacuuuagcaaugccaucagcaaaagccaggccuucucuuugauucuugcccaccacaucaugggugccggguuuggcuuccauaacaucaaagauccugaccagaacacauuugcuggccuggccagaaguucagugagacaccuggaucuuucacauggguuugucuucucccugaacucacgagucuuugagacacucaaggauuugaagguucugaaccuugccuacaacaagauaaauaagauugcagaugaagcauuuuacggacuugacaaccuccaaguucucaauuugucauauaaccuucugggggaacuuuacgguucgaauuucuauggacuaccuaagguagccuacauugauuugcaaaagaaucacauugcaauaauucaagaccaaacauucaaauuccuggaaaaauuacagaccuuggaucuccgagacaaugcucuuacaaccauucauuuuauuccaagcauacccgauaucuucuugaguggcaauaaacuagugacuuugccaaagaucaaccuuacagcgaaccucauccacuuaucagaaaacaggcuagaaaaucuagauauucucuacuuucuccuacggguaccucaucuccagauucucauuuuaaaucaaaaucgcuucuccuccuguaguggagaucaaaccccuucagagaaucccagcuuagaacagcuuuuccuuggagaaaauauguugcaacuugccugggaaacugagcucuguugggauguuuuugagggacuuucucaucuucaaguucuguauuugaaucauaacuaucuuaauucccuuccaccaggaguauuuagccaucugacugcauuaaggggacuaagccucaacuccaacaggcugacaguucuuucucacaaugauuuaccugcuaauuuagagauccuggacauauccaggaaccagcuccuagcuccuaauccugauguauuuguaucacuuagugucuuggauauaacucauaacaaguucauuugugaaugugaacuuagcacuuuuaucaauuggcuuaaucacaccaaugucacuauagcugggccuccugcagacauauauuguguguacccugacucguucucugggguuucccucuucucucuuuccacggaagguugugaugaagaggaagucuuaaagucccuaaaguucucccuuuucuuuguaugcacugucacucugacucuguuccucaugaccauccucacagucacaaaguuccggggcuucuguuuuaucuguuauaagacagcccagagacugguguucaaggaccauccccagggcacagaaccugauauguacaaauaugaugccuauuugugcuucagcagcaaagacuucacaugggugcagaaugcuuugcucaaacaccuggacacucaauacagugaccaaaacagauucaaccugugcuuugaagaaagagacuuugucccaggagaaaaccgcauugccaauauccaggaugccaucuggaacaguagaaagaucguuugucuugugagcagacacuuccuuagagauggcuggugccuugaagccuucaguuaugcccagggcaggugcuuaucugaccuuaacagugcucucaucaugguggugguuggguccuugucccaguaccaguugaugaaacaucaauccaucagaggcuuuguacagaaacagcaguauuugagguggccugaggaucuccaggauguuggcugguuucuucauaaacucucucaacagauacuaaagaaagaaaaagaaaagaagaaagacaauaacauuccguugcaaacuguagcaaccaucuccuaa

SEQ ID NO: 9650 - RNA, 2577 nt, Artificial Sequence
  derived and/or modified sequence opt1 from TLR5__Homo_sapiens__AAZ17471
augggcgaccaccuggaccuccugcugggggugguccucauggccggccccguguucgggaucccgagcugcuccuucgacggccgcaucgccuucuaccgguucugcaaccugacccaggugccccagguccugaacaccacggagcgccuccugcugagcuucaacuacauccggaccgugaccgcguccagcuuccccuuccucgagcagcugcagcugcucgagcuggggucccaguacacgccccugaccaucgacaaggaggccuuccgcaaccucccgaaccugcggauccuggaccucggcagcuccaagaucuacuuccugcaccccgacgccuuccagggccuguuccaccucuucgagcugcgccuguacuucugcgggcucagcgacgccgugcugaaggacggcuacuuccggaaccugaaggcccucacccgccuggaccuguccaagaaccagauccggagccucuaccugcaccccuccuucgggaagcugaacagccucaaguccaucgacuucagcuccaaccagaucuuccuggucugcgagcacgagcuggagccccuccagggcaagacccugagcuucuucucccuggcggccaacagccucuacucccgcgugagcguggacugggggaagugcaugaacccguuccggaacaugguccuggagauccuggacgugagcggcaacggcuggaccguggacaucacggggaacuucuccaacgccaucagcaagucccaggccuucagccucauccuggcgcaccacaucaugggcgccggguucggcuuccacaacaucaaggaccccgaccagaacaccuucgccggccuggcccgcuccagcguccggcaccucgaccugucccacggguucguguucagccugaacucccgcguguucgagacccucaaggaccugaagguccugaaccuggccuacaacaagaucaacaagaucgcggacgaggccuucuacggccucgacaaccuccaggugcugaaccugagcuacaaccugcugggggagcucuacggcuccaacuucuacgggcugcccaagguggccuacaucgaccugcagaagaaccacaucgccaucauccaggaccagaccuucaaguuccucgagaagcugcagacgcuggaccuccgggacaacgcccugaccaccauccacuucauccccagcaucccggacaucuuccuguccggcaacaagcucgucacccugcccaagaucaaccugacggcgaaccucauccaccugagcgagaaccgccuggagaaccucgacauccuguacuuccugcuccgggugccccaccuccagauccugauccugaaccagaaccgcuucuccagcugcuccggcgaccagacccccagcgagaacccgucccuggagcagcuguuccucggggagaacaugcugcagcuggccugggagaccgagcucugcugggacguguucgagggccugagccaccuccagguccuguaccugaaccacaacuaccugaacagccucccgcccgggguguucucccaccugaccgcccugcggggccucagccugaacuccaaccgccugacggugcucagccacaacgaccugcccgccaaccuggagauccucgacaucucccggaaccagcugcuggcccccaaccccgacgucuucgugagccucuccguccuggacaucacccacaacaaguucaucugcgagugcgagcugagcaccuucaucaacuggcucaaccacaccaacgugacgaucgcggggccgcccgccgacaucuacugcguguaccccgacuccuucagcggcgucucccuguucagccuguccaccgagggcugcgacgaggaggaggugcucaagagccugaaguucucccuguucuucgugugcaccgucacccucacgcuguuccugaugaccauccucaccgugaccaaguuccgcggguucugcuucaucugcuacaagacggcccagcgccugguguucaaggaccacccccagggcaccgagcccgacauguacaaguacgacgccuaccugugcuucagcuccaaggacuucaccuggguccagaacgcccuccugaagcaccuggacacccaguacagcgaccagaaccgguucaaccucugcuucgaggagcgcgacuucgugcccggggagaaccggaucgcgaacauccaggacgccaucuggaacagccgcaagaucgugugccuggucucccggcacuuccugcgcgacggcuggugccucgaggccuucagcuacgcccaggggcggugccuguccgaccugaacagcgcgcucaucauggugguggucggcucccugagccaguaccagcugaugaagcaccaguccauccgcggcuucgugcagaagcagcaguaccuccgguggccggaggaccugcaggacguggggugguuccugcacaagcucagccagcagauccugaagaaggagaaggagaagaagaaggacaacaacaucccccugcagacggucgccaccaucuccuga

SEQ ID NO: 9651 - RNA, 2577 nt, Artificial Sequence
  derived and/or modified sequence opt2 from TLR5__Homo_sapiens__AAZ17471
augggcgaccaccucgaccuccuccucggcgucguccucauggccggccccgucuucggcauccccuccugcuccuucgacggccgcaucgccuucuaccgcuucugcaaccucacccaggucccccagguccucaacaccaccgagcgccuccuccucuccuucaacuacauccgcaccgucaccgccuccuccuuccccuuccucgagcagcuccagcuccucgagcucggcucccaguacaccccccucaccaucgacaaggaggccuuccgcaaccuccccaaccuccgcauccucgaccucggcuccuccaagaucuacuuccuccaccccgacgccuuccagggccucuuccaccucuucgagcuccgccucuacuucugcggccucuccgacgccguccucaaggacggcuacuuccgcaaccucaaggcccucacccgccucgaccucuccaagaaccagauccgcucccucuaccuccaccccuccuucggcaagcucaacucccucaaguccaucgacuucuccuccaaccagaucuuccucgucugcgagcacgagcucgagccccuccagggcaagacccucuccuucuucucccucgccgccaacucccucuacucccgcgucuccgucgacuggggcaagugcaugaaccccuuccgcaacaugguccucgagauccucgacgucuccggcaacggcuggaccgucgacaucaccggcaacuucuccaacgccaucuccaagucccaggccuucucccucauccucgcccaccacaucaugggcgccggcuucggcuuccacaacaucaaggaccccgaccagaacaccuucgccggccucgcccgcuccuccguccgccaccucgaccucucccacggcuucgucuucucccucaacucccgcgucuucgagacccucaaggaccucaagguccucaaccucgccuacaacaagaucaacaagaucgccgacgaggccuucuacggccucgacaaccuccagguccucaaccucuccuacaaccuccucggcgagcucuacggcuccaacuucuacggccuccccaaggucgccuacaucgaccuccagaagaaccacaucgccaucauccaggaccagaccuucaaguuccucgagaagcuccagacccucgaccuccgcgacaacgcccucaccaccauccacuucauccccuccauccccgacaucuuccucuccggcaacaagcucgucacccuccccaagaucaaccucaccgccaaccucauccaccucuccgagaaccgccucgagaaccucgacauccucuacuuccuccuccgcgucccccaccuccagauccucauccucaaccagaaccgcuucuccuccugcuccggcgaccagacccccuccgagaaccccucccucgagcagcucuuccucggcgagaacaugcuccagcucgccugggagaccgagcucugcugggacgucuucgagggccucucccaccuccagguccucuaccucaaccacaacuaccucaacucccucccccccggcgucuucucccaccucaccgcccuccgcggccucucccucaacuccaaccgccucaccguccucucccacaacgaccuccccgccaaccucgagauccucgacaucucccgcaaccagcuccucgcccccaaccccgacgucuucgucucccucuccguccucgacaucacccacaacaaguucaucugcgagugcgagcucuccaccuucaucaacuggcucaaccacaccaacgucaccaucgccggcccccccgccgacaucuacugcgucuaccccgacuccuucuccggcgucucccucuucucccucuccaccgagggcugcgacgaggaggagguccucaagucccucaaguucucccucuucuucgucugcaccgucacccucacccucuuccucaugaccauccucaccgucaccaaguuccgcggcuucugcuucaucugcuacaagaccgcccagcgccucgucuucaaggaccacccccagggcaccgagcccgacauguacaaguacgacgccuaccucugcuucuccuccaaggacuucaccuggguccagaacgcccuccucaagcaccucgacacccaguacuccgaccagaaccgcuucaaccucugcuucgaggagcgcgacuucguccccggcgagaaccgcaucgccaacauccaggacgccaucuggaacucccgcaagaucgucugccucgucucccgccacuuccuccgcgacggcuggugccucgaggccuucuccuacgcccagggccgcugccucuccgaccucaacuccgcccucaucauggucgucgucggcucccucucccaguaccagcucaugaagcaccaguccauccgcggcuucguccagaagcagcaguaccuccgcuggcccgaggaccuccaggacgucggcugguuccuccacaagcucucccagcagauccucaagaaggagaaggagaagaagaaggacaacaacaucccccuccagaccgucgccaccaucuccuga

SEQ ID NO: 9652 - RNA, 2577 nt, Artificial Sequence
  derived and/or modified sequence opt3 from TLR5__Homo_sapiens__AAZ17471
augggcgaccaccuggaucuccuucuggggguggucuugauggccggacccguuuucgguaucccuagcugcuccuuugacggcagaauugcuuucuacagguuuuguaacuuaacccaggugccacaaguacugaauacaacugagcggcuacuccugucuuucaacuauauacgcacggugaccgcaucaaguuuuccguuccuugaacagcugcaguugcucgagcuggggagccaguacacaccccugacuaucgauaaggaagccuuucgaaaucucccuaacuuacguauucuggaccuuggauccucuaaaaucuauuucuugcauccagaugcguuucaaggccuguuccaccuauuugagcucagacuguacuucugcggucuuucggacgcuguccugaaggauggguauuuuaggaauuugaaagcccucacccggcuggacuuaucaaagaaccagauucgcagccuguaccuccaucccaguuucggaaaacuuaauucccugaagucuaucgauuucagcuccaaccagauauuuuuggugugugaacacgagcuagagccucugcagggcaagacacucucauucuuuagucuggcagccaauagccuuuauucuagaguuuccguggacuggggcaaaugcaugaacccauucaggaauaugguccuggaaaucuuggaugugucagggaacggauggaccguagacauuacugguaauuuuagcaacgcuaucaguaagucucaagcauucucccucauucuggcccaucacaucaugggcgcuggguuuggauuccacaauauaaaagaucccgaccagaacacauuugccggcuuagcgcggagcucgguucgccaucuggaccuaucucacgguuucguguuuucccucaacucacgagucuucgagacccugaaggaucuuaaaguguugaaucuggcauacaacaagauuaauaagaucgccgacgaggcuuuuuacgggcucgauaaccugcaagugcuuaaucugaguuauaacuugcucggagaacuguacggcagcaauuucuauggcuuaccuaaagucgccuacauugaccugcagaagaaccauaucgcaaucauucaggaucagacguucaaauuucuagagaagcuccagacucuggaccuuagagauaaugcuuugaccacaauacacuucaucccauccauuccggacaucuuucugucugggaacaaacucguuacucugcccaagauaaauuuaaccgccaaccugauucaccuuagcgaaaauagguuggagaaccucgauauccuguauuuccuacugcgggugccucaucuccaaauccugauucuuaaucagaaccguuuuucaaguuguuccggagaccagacaccaagcgaaaaccccucuuuggagcagcuguucuuaggugaaaauaugcuccaacuggcgugggagaccgagcuuugcugggauguauuugaaggccugucacaccuccagguguuguaccugaaccauaauuaucuaaacagucugccuccaggggucuucagccaccucacggcccugcgcggacuuuccuugaacucuaauagacugacuguguuaucgcauaaugaccuccccgcaaaccuggagauccuugacauuagcaggaaucagcugcuagcuccgaacccugauguuuuugugucccucucaguccuggacauaacacacaauaaauucaucugugaaugcgaguugaguaccuuuauuaacuggcugaaucacacuaacgugacaaucgccggucccccagcugauaucuacuguguauacccugacucuuucagcggcguuuccuuauuuucacucagcaccgaagggugcgaugaggaggaagugcugaagucucuuaaguucucccuguucuuugucuguacggugaccuugacacucuuccugaugacuauucuaaccgucacaaaauuucggggcuucugcuuuauaugcuauaagacugcccagcgacugguguucaaagaccauccccaaggaaccgagccagauauguacaaguaugacgcauaccuuuguuuuaguagcaaagauuucacauggguucagaaugcccuccugaagcacuuggacacccaguauucugaucagaaccgcuuuaaccugugcuucgaagagagagacuuugugcccggcgaaaauaggaucgcuaacauucaagaugcgaucuggaacucccggaagauuguauguuuagucucacgccauuuccucagagacggguggugccuggaggcauucaguuacgcccagggaaggugucuuagcgaccugaacucggcuuugaucauggugguuguggguucccucucucaguaucagcugaugaaacaccaaagcauacguggcuuuguccagaagcagcaauaccuacgguggccugaggaucugcaggacguggggugguuccuucacaaacucucacagcagauccugaagaaagaaaaggagaagaaaaaggauaauaauauuccauugcaaacuguagccacgaucaguuga

SEQ ID NO: 9653 - RNA, 2577 nt, Artificial Sequence
  derived and/or modified sequence opt4 from TLR5__Homo_sapiens__AAZ17471
augggcgaccaccuggaccugcugcugggcguggugcugauggccggccccguguucggcauccccagcugcagcuucgacggcagaaucgccuucuacagauucugcaaccugacccaggugccccaggugcugaacaccaccgagagacugcugcugagcuucaacuacaucagaaccgugaccgccagcagcuuccccuuccuggagcagcugcagcugcuggagcugggcagccaguacaccccccugaccaucgacaaggaggccuucagaaaccugcccaaccugagaauccuggaccugggcagcagcaagaucuacuuccugcaccccgacgccuuccagggccuguuccaccuguucgagcugagacuguacuucugcggccugagcgacgccgugcugaaggacggcuacuucagaaaccugaaggcccugaccagacuggaccugagcaagaaccagaucagaagccuguaccugcaccccagcuucggcaagcugaacagccugaagagcaucgacuucagcagcaaccagaucuuccuggugugcgagcacgagcuggagccccugcagggcaagacccugagcuucuucagccuggccgccaacagccuguacagcagagugagcguggacuggggcaagugcaugaaccccuucagaaacauggugcuggagauccuggacgugagcggcaacggcuggaccguggacaucaccggcaacuucagcaacgccaucagcaagagccaggccuucagccugauccuggcccaccacaucaugggcgccggcuucggcuuccacaacaucaaggaccccgaccagaacaccuucgccggccuggccagaagcagcgugagacaccuggaccugagccacggcuucguguucagccugaacagcagaguguucgagacccugaaggaccugaaggugcugaaccuggccuacaacaagaucaacaagaucgccgacgaggccuucuacggccuggacaaccugcaggugcugaaccugagcuacaaccugcugggcgagcuguacggcagcaacuucuacggccugcccaagguggccuacaucgaccugcagaagaaccacaucgccaucauccaggaccagaccuucaaguuccuggagaagcugcagacccuggaccugagagacaacgcccugaccaccauccacuucauccccagcauccccgacaucuuccugagcggcaacaagcuggugacccugcccaagaucaaccugaccgccaaccugauccaccugagcgagaacagacuggagaaccuggacauccuguacuuccugcugagagugccccaccugcagauccugauccugaaccagaacagauucagcagcugcagcggcgaccagacccccagcgagaaccccagccuggagcagcuguuccugggcgagaacaugcugcagcuggccugggagaccgagcugugcugggacguguucgagggccugagccaccugcaggugcuguaccugaaccacaacuaccugaacagccugccccccggcguguucagccaccugaccgcccugagaggccugagccugaacagcaacagacugaccgugcugagccacaacgaccugcccgccaaccuggagauccuggacaucagcagaaaccagcugcuggcccccaaccccgacguguucgugagccugagcgugcuggacaucacccacaacaaguucaucugcgagugcgagcugagcaccuucaucaacuggcugaaccacaccaacgugaccaucgccggcccccccgccgacaucuacugcguguaccccgacagcuucagcggcgugagccuguucagccugagcaccgagggcugcgacgaggaggaggugcugaagagccugaaguucagccuguucuucgugugcaccgugacccugacccuguuccugaugaccauccugaccgugaccaaguucagaggcuucugcuucaucugcuacaagaccgcccagagacugguguucaaggaccacccccagggcaccgagcccgacauguacaaguacgacgccuaccugugcuucagcagcaaggacuucaccugggugcagaacgcccugcugaagcaccuggacacccaguacagcgaccagaacagauucaaccugugcuucgaggagagagacuucgugcccggcgagaacagaaucgccaacauccaggacgccaucuggaacagcagaaagaucgugugccuggugagcagacacuuccugagagacggcuggugccuggaggccuucagcuacgcccagggcagaugccugagcgaccugaacagcgcccugaucauggugguggugggcagccugagccaguaccagcugaugaagcaccagagcaucagaggcuucgugcagaagcagcaguaccugagauggcccgaggaccugcaggacgugggcugguuccugcacaagcugagccagcagauccugaagaaggagaaggagaagaagaaggacaacaacaucccccugcagaccguggccaccaucagcuga

SEQ ID NO: 9654 - RNA, 2577 nt, Artificial Sequence
  derived and/or modified sequence opt5 from TLR5__Homo_sapiens__AAZ17471
augggcgaccaccuggaucuccugcuuggggugguccugauggccggacccguuuucggcaucccuagcugcuccuuugacgggagaauugcuuucuaccgguuuuguaaccucacccaggugccgcaagugcugaauacaacggagcgccuucugcucucuuucaacuauaucagaaccgucacagccagcuccuuucccuuccuggaacagcugcagcuccuggagcuuggaucucaguacaccccucugacaauugauaaggaagcguuucggaaucuccccaaccugcgcauccuugaccugggcagcuccaaaauuuauuuccuccauccugaugcuuuucaagggcuguuccaccuguuugagcucagacuguacuucugcggacuuucugacgccgugcugaaggauggcuauuuucggaaucucaaagcccugacccgccuugaccugagcaagaaccagaucagaucccucuaccugcaucccagcuucggcaaacucaauucucucaaguccaucgauuucagcucuaaccagauuuuucugguuugugaacacgagcuugagccucugcaggggaagacacucuccuucuuuagccuggcugccaauucucuuuauucccgggugagcgucgacuggggaaaaugcaugaacccguuccgcaauauggugcuggaaauccucgauguuuccggcaacggguggaccguggacauuacgggaaauuuuucuaacgcuaucagcaagucccaagccuucagccugauucuggcgcaucacaucaugggcgccggguuuggauuccacaauauuaaagaucccgaccagaacaccuuugcuggccucgccagaucuuccguccggcaucuggaccuuagccacggcuucguguuuucucugaacagccgcguguucgagacacucaaggaucugaaaguccugaaucuugcuuacaacaagaucaauaagaucgccgacgaagcguuuuacgggcucgauaaccugcagguucugaaucucuccuauaaccugcuuggagagcuguacggcucuaauuucuaugggcucccuaaaguggccuacauugaccugcagaagaaccauaucgcuauuauccaagaucagaccuucaaauuucuggagaagcugcagacacucgaccugagagauaaugcccugaccacgauucacuucauccccagcaucccugacauuuuucucuccggaaacaaacuggugacacuucccaagaucaaucugaccgcuaaccucauucaccugagcgaaaaucggcuggagaaccuugauauccucuauuuccugcugcgcgucccgcaucuccaaauucugauccuuaaucagaacagauuuucuuccuguagcggcgaccagacaccuucugaaaaccccucccuggagcagcuguuccugggggaaaauaugcugcaacuugccugggagaccgagcucugcugggauguguuugaaggacugagccaccuucagguucucuaccugaaccauaauuaucuuaacucccugccucccggcguguucucucaccucaccgcccugcggggccugagccuuaauuccaacagacugacaguccucucucauaaugaccugcccgcuaaccucgagauccuggacauuagccgcaaucagcuucuggcgccuaacccggauguguuuguuucccucagcgugcuggacaucacgcacaauaaauucauuugugaaugcgagcugucuaccuuuaucaacuggcuuaaucacacaaacgucaccauugccgggcccccugcugauaucuacuguguguaccccgacuccuucagcggagucucucuguuuucccucagcacagaaggcugcgaugaggaggaagugcugaagucucucaaguucagccuguucuuuguuuguaccgugacgcuuacacuguuccucaugaccauucugaccgucacaaaauuucggggguucugcuuuaucugcuauaagaccgcccagagacugguguucaaagaccauccucaaggaacagagcccgauauguacaaguaugacgccuaccuuuguuuuuccagcaaagauuucacguggguucagaaugcucugcucaagcaccuggacacccaguauucugaucagaaccgcuuuaaccucugcuucgaggaacgggacuuugugccgggcgaaaauagaaucgccaacauucaagaugcgaucuggaacucccgcaagauugucugucuggugagccggcauuuccuuagagacggguggugccuggaggcuuucuccuacgcccagggccgcugucugucugaccucaauagcgcccugaucauggugguugucggaucccuuucucaguaucagcugaugaaacaccaaagcauucggggcuuugugcagaagcagcaauaccucagauggccugaggaucugcaggacguggggugguuccuccacaaacugucccagcagauccuuaagaaagaaaaggagaagaaaaaggauaauaacaucccccugcaaacagucgcuaccauuucuuga

SEQ ID NO: 9655 - protein, 858 aa, Artificial Sequence [sequence omitted]

SEQ ID NO: 9656 - RNA, 2577 nt, Artificial Sequence
  TLR5__Homo_sapiens__AAZ17472
augggagaccaccuggaccuucuccuaggaguggugcucauggccgguccuguguuuggaauuccuuccugcuccuuugauggccgaauagccuuuuaucguuucugcaaccucacccaggucccccagguccucaacaccacugagaggcuccugcugagcuucaacuauaucaggacagucacugcuucauccuuccccuuucuggaacagcugcagcugcuggagcucgggagccaguauacccccuugacuauugacaaggaggccuucagaaaccugcccaaccuuagaaucuuggaccugggaaguaguaagauauacuucuugcauccagaugcuuuucagggacuguuccaucuguuugaacuuagacuguauuucuguggucucucugaugcuguauugaaagaugguuauuucagaaauuuaaaggcuuuaacucgcuuggaucuauccaaaaaucagauucguagccuuuaccuucauccuucauuugggaaguugaauuccuuaaaguccauagauuuuuccuccaaccaaauauuccuuguaugugaacaugagcucgagccccuacaagggaaaacgcucuccuuuuuuagccucgcagcuaauagcuuguauagcagagucucaguggacuggggaaaauguaugaacccauucagaaacauggugcuggagauacuagauguuucuggaaauggcuggacaguggacaucacaggaaacuuuaccaaugccaucagcaaaagccaggccuucucuuugauucuugcccaccacaucaugggugccggguuuggcuuccauaacaucaaagauccugaccagaacacauuugcuggccuggccagaaguucagugagacaccuggaucuuucacauggguuugucuucucccugaacucacgagucuuugagacacucaaggauuugaagguucugaaccuugccuacaacaagauaaauaagauugcagaugaagcauuuuacggacuugacaaccuccaaguucucaauuugucauauaaccuucugggggaacuuuacaguucgaauuucuauggacuaccuaagguagccuacauugauuugcaaaagaaucacauugcaauaauucaagaccaaacauucaaauuccuggaaaaauuacagaccuuggaucuccgagacaaugcucuuacaaccauucauuuuauuccaagcauacccgauaucuucuugaguggcaauaaacuagugacuuugccaaagaucaaccuuacagcgaaccucauccacuuaucagaaaacaggcuagaaaaucuagauauucucuacuuucuccuacggguaccucaucuccagauucucauuuuaaaucaaaaucgcuucuccuccuguaguggagaucaaaccccuucagagaaucccagcuuagaacagcuuuuccuuggagaaaauauguugcaacuugccugggaaacugagcucuguugggauguuuuugagggacuuucucaucuucaaguucuguauuugaaucauaacuaucuuaauucccuuccaccaggaguauuuagccaucugacugcauuaaggggacuaagccucaacuccaacaggcugacaguucuuucucacaaugauuuaccugcuaauuuagagauccuggacauauccaggaaccagcuccuagcuccuaauccugauguauuuguaucacuuagugucuuggauauaacucauaacaaguucauuugugaaugugaacuuagcacuuuuaucaauuggcuuaaucacaccaaugucacuauagcugggccuccugcagacauauauuguguguacccugacucguucucugggguuucccucuucucucuuuccacggaagguugugaugaagaggaagucuuaaagucccuaaaguucucccuuuucuuuguaugcacugucacucugacucuguuccucaugaccauccucacagucacaaaguuccggggcuucuguuuuaucuguuauaagacagcccagagacugguguucaaggaccauccccagggcacagaaccugauauguacaaauaugaugccuauuugugcuucagcagcaaagacuucacaugggugcagaaugcuuugcucaaacaccuggacacucaauacagugaccaaaacagauucaaccugugcuuugaagaaagagacuuugucccaggagaaaaccgcauugccaauauccaggaugccaucuggaacaguagaaagaucguuugucuugugagcagacacuuccuuagagauggcuggugccuugaagccuucaguuaugcccagggcaggugcuuaucugaccuuaacagugcucucaucaugguggugguuggguccuugucccaguaccaguugaugaaacaucaauccaucagaggcuuuguacagaaacagcaguauuugagguggccugaggaucuccaggauguuggcugguuucuucauaaacucucucaacagauacuaaagaaagaaaaagaaaagaagaaagacaauaacauuccguugcaaacuguagcaaccaucuccuaa

SEQ ID NO: 9657 - RNA, 2577 nt, Artificial Sequence
  derived and/or modified sequence opt1 from TLR5__Homo_sapiens__AAZ17472
augggcgaccaccuggaccuccugcugggggugguccucauggccggccccguguucgggaucccgagcugcuccuucgacggccgcaucgccuucuaccgguucugcaaccugacccaggugccccagguccugaacaccacggagcgccuccugcugagcuucaacuacauccggaccgugaccgcguccagcuuccccuuccucgagcagcugcagcugcucgagcuggggucccaguacacgccccugaccaucgacaaggaggccuuccgcaaccucccgaaccugcggauccuggaccucggcagcuccaagaucuacuuccugcaccccgacgccuuccagggccuguuccaccucuucgagcugcgccuguacuucugcgggcucagcgacgccgugcugaaggacggcuacuuccggaaccugaaggcccucacccgccuggaccuguccaagaaccagauccggagccucuaccugcaccccuccuucgggaagcugaacagccucaaguccaucgacuucagcuccaaccagaucuuccuggucugcgagcacgagcuggagccccuccagggcaagacccugagcuucuucucccuggcggccaacagccucuacucccgcgugagcguggacugggggaagugcaugaacccguuccggaacaugguccuggagauccuggacgugagcggcaacggcuggaccguggacaucacggggaacuucaccaacgccaucuccaagagccaggccuucucccucauccuggcgcaccacaucaugggcgccggguucggcuuccacaacaucaaggaccccgaccagaacaccuucgccggccuggcccgcagcuccguccggcaccucgaccugagccacggguucguguucucccugaacagccgcguguucgagacccucaaggaccugaagguccugaaccuggccuacaacaagaucaacaagaucgcggacgaggccuucuacggccucgacaaccuccaggugcugaaccuguccuacaaccugcugggggagcucuacagcuccaacuucuacggccugcccaagguggccuacaucgaccugcagaagaaccacaucgccaucauccaggaccagacguucaaguuccucgagaagcugcagacccuggaccuccgggacaacgcccugaccaccauccacuucauccccagcaucccggacaucuuccuguccgggaacaagcucgucacgcugcccaagaucaaccugaccgcgaaccucauccaccugagcgagaaccgccuggagaaccucgacauccuguacuuccugcuccgggugccccaccuccagauccugauccugaaccagaaccgcuucuccagcugcuccggcgaccagacccccagcgagaacccgucccuggagcagcuguuccucggcgagaacaugcugcagcuggccugggagaccgagcucugcugggacguguucgaggggcugagccaccuccagguccuguaccugaaccacaacuaccugaacagccucccgcccggcguguucucccaccugacggcccugcgggggcucagccugaacuccaaccgccugaccgugcucagccacaacgaccugcccgccaaccuggagauccucgacaucucccggaaccagcugcuggcccccaaccccgacgucuucgugagccucuccguccuggacaucacccacaacaaguucaucugcgagugcgagcugagcaccuucaucaacuggcucaaccacacgaacgugaccaucgcgggcccgcccgccgacaucuacugcguguaccccgacuccuucagcggggucucccuguucagccuguccaccgagggcugcgacgaggaggaggugcucaagagccugaaguucucccuguucuucgugugcaccgucacgcucacccuguuccugaugaccauccucaccgugacgaaguuccgcggcuucugcuucaucugcuacaagaccgcccagcgccugguguucaaggaccacccccaggggaccgagcccgacauguacaaguacgacgccuaccugugcuucagcuccaaggacuucaccuggguccagaacgcccuccugaagcaccuggacacgcaguacagcgaccagaaccgguucaaccucugcuucgaggagcgcgacuucgugcccggcgagaaccggaucgcgaacauccaggacgccaucuggaacagccgcaagaucgugugccuggucucccggcacuuccugcgcgacggguggugccucgaggccuucagcuacgcccagggccggugccuguccgaccugaacagcgcgcucaucauggugguggucgggucccugagccaguaccagcugaugaagcaccaguccauccgcggcuucgugcagaagcagcaguaccuccgguggccggaggaccugcaggacgugggcugguuccugcacaagcucagccagcagauccugaagaaggagaaggagaagaagaaggacaacaacaucccccugcagaccgucgccaccaucuccuga

SEQ ID NO: 9658 - RNA, 2577 nt, Artificial Sequence
  derived and/or modified sequence opt2 from TLR5__Homo_sapiens__AAZ17472
augggcgaccaccucgaccuccuccucggcgucguccucauggccggccccgucuucggcauccccuccugcuccuucgacggccgcaucgccuucuaccgcuucugcaaccucacccaggucccccagguccucaacaccaccgagcgccuccuccucuccuucaacuacauccgcaccgucaccgccuccuccuuccccuuccucgagcagcuccagcuccucgagcucggcucccaguacaccccccucaccaucgacaaggaggccuuccgcaaccuccccaaccuccgcauccucgaccucggcuccuccaagaucuacuuccuccaccccgacgccuuccagggccucuuccaccucuucgagcuccgccucuacuucugcggccucuccgacgccguccucaaggacggcuacuuccgcaaccucaaggcccucacccgccucgaccucuccaagaaccagauccgcucccucuaccuccaccccuccuucggcaagcucaacucccucaaguccaucgacuucuccuccaaccagaucuuccucgucugcgagcacgagcucgagccccuccagggcaagacccucuccuucuucucccucgccgccaacucccucuacucccgcgucuccgucgacuggggcaagugcaugaaccccuuccgcaacaugguccucgagauccucgacgucuccggcaacggcuggaccgucgacaucaccggcaacuucaccaacgccaucuccaagucccaggccuucucccucauccucgcccaccacaucaugggcgccggcuucggcuuccacaacaucaaggaccccgaccagaacaccuucgccggccucgcccgcuccuccguccgccaccucgaccucucccacggcuucgucuucucccucaacucccgcgucuucgagacccucaaggaccucaagguccucaaccucgccuacaacaagaucaacaagaucgccgacgaggccuucuacggccucgacaaccuccagguccucaaccucuccuacaaccuccucggcgagcucuacuccuccaacuucuacggccuccccaaggucgccuacaucgaccuccagaagaaccacaucgccaucauccaggaccagaccuucaaguuccucgagaagcuccagacccucgaccuccgcgacaacgcccucaccaccauccacuucauccccuccauccccgacaucuuccucuccggcaacaagcucgucacccuccccaagaucaaccucaccgccaaccucauccaccucuccgagaaccgccucgagaaccucgacauccucuacuuccuccuccgcgucccccaccuccagauccucauccucaaccagaaccgcuucuccuccugcuccggcgaccagacccccuccgagaaccccucccucgagcagcucuuccucggcgagaacaugcuccagcucgccugggagaccgagcucugcugggacgucuucgagggccucucccaccuccagguccucuaccucaaccacaacuaccucaacucccucccccccggcgucuucucccaccucaccgcccuccgcggccucucccucaacuccaaccgccucaccguccucucccacaacgaccuccccgccaaccucgagauccucgacaucucccgcaaccagcuccucgcccccaaccccgacgucuucgucucccucuccguccucgacaucacccacaacaaguucaucugcgagugcgagcucuccaccuucaucaacuggcucaaccacaccaacgucaccaucgccggcccccccgccgacaucuacugcgucuaccccgacuccuucuccggcgucucccucuucucccucuccaccgagggcugcgacgaggaggagguccucaagucccucaaguucucccucuucuucgucugcaccgucacccucacccucuuccucaugaccauccucaccgucaccaaguuccgcggcuucugcuucaucugcuacaagaccgcccagcgccucgucuucaaggaccacccccagggcaccgagcccgacauguacaaguacgacgccuaccucugcuucuccuccaaggacuucaccuggguccagaacgcccuccucaagcaccucgacacccaguacuccgaccagaaccgcuucaaccucugcuucgaggagcgcgacuucguccccggcgagaaccgcaucgccaacauccaggacgccaucuggaacucccgcaagaucgucugccucgucucccgccacuuccuccgcgacggcuggugccucgaggccuucuccuacgcccagggccgcugccucuccgaccucaacuccgcccucaucauggucgucgucggcucccucucccaguaccagcucaugaagcaccaguccauccgcggcuucguccagaagcagcaguaccuccgcuggcccgaggaccuccaggacgucggcugguuccuccacaagcucucccagcagauccucaagaaggagaaggagaagaagaaggacaacaacaucccccuccagaccgucgccaccaucuccuga

SEQ ID NO: 9659 - RNA, 2577 nt, Artificial Sequence
  derived and/or modified sequence opt3 from TLR5__Homo_sapiens__AAZ17472
augggcgaccaccuggaucuccuucuggggguggucuugauggccggacccguuuucgguaucccuagcugcuccuuugacggcagaauugcuuucuacagguuuuguaacuuaacccaggugccacaaguacugaauacaacugagcggcuacuccugucuuucaacuauauacgcacggugaccgcaucaaguuuuccguuccuugaacagcugcaguugcucgagcuggggagccaguacacaccccugacuaucgauaaggaagccuuucgaaaucucccuaacuuacguauucuggaccuuggauccucuaaaaucuauuucuugcauccagaugcguuucaaggccuguuccaccuauuugagcucagacuguacuucugcggucuuucggacgcuguccugaaggauggguauuuuaggaauuugaaagcccucacccggcuggacuuaucaaagaaccagauucgcagccuguaccuccaucccaguuucggaaaacuuaauucccugaagucuaucgauuucagcuccaaccagauauuuuuggugugugaacacgagcuagagccucugcagggcaagacacucucauucuuuagucuggcagccaauagccuuuauucuagaguuuccguggacuggggcaaaugcaugaacccauucaggaauaugguccuggaaaucuuggaugugucagggaacggauggaccguagacauuacugguaauuuuacaaacgcuaucagcaagagucaagcauucucucucauucuggcccaucacaucaugggcgcuggguuuggauuccacaauauaaaagaucccgaccagaacaccuuugccggcuuagcgcgguccagcguucgccaucuggaccuaucgcacgguuucguguuuucucucaacucccgagucuucgagacgcugaaggaucuuaaaguguugaaucuggcauacaacaagauuaauaagaucgccgacgaggcuuuuuacgggcucgauaaccugcaagugcuuaaucugucauauaacuugcucggagaacuguacaguagcaauuucuauggcuuaccuaaagucgccuacauugaccugcagaagaaccauaucgcaaucauucaggaucagacuuucaaauuucuagagaagcuccagacccuggaccuuagagauaaugcuuugacaacuauacacuucaucccauccauuccggacaucuuucugucuggcaacaaacucguuacccugcccaagauaaauuuaacagccaaccugauucaccuuagcgaaaauagguuggagaaccucgauauccuguauuuccuacugcgggugccucaucuccaaauccugauucuuaaucagaaccguuuuucaaguuguuccggggaccagaccccaagcgaaaaccccucuuuggagcagcuguucuuaggagaaaauaugcuccaacuggcgugggagacggagcuuugcugggauguauuugaaggucugucacaccuccagguguuguaccugaaccauaauuaucuaaacagucugccuccaggcgucuucagccaccucacugcccugcgcgggcuuuccuugaacucuaauagacugacaguguuaucgcauaaugaccuccccgcaaaccuggagauccuugacauuagcaggaaucagcugcuagcuccgaacccugauguuuuugugucccucucaguccuggacauaacccacaauaaauucaucugugaaugcgaguugaguacuuuuauuaacuggcugaaucacacaaacgugaccaucgccggacccccagcugauaucuacuguguauacccugacucuuucagcggcguuuccuuauuuucacucagcacggaagguugcgaugaggaggaagugcugaagucucuuaaguucucccuguucuuugucuguaccgugacauugacucucuuccugaugaccauucuaacagucacuaaauuucggggguucugcuuuauaugcuauaagaccgcccagcgacugguguucaaagaccauccccaaggcacagagccagauauguacaaguaugacgcauaccuuuguuuuaguagcaaagauuucaccuggguucagaaugcccuccugaagcacuuggacacucaguauucugaucagaaccgcuuuaaccugugcuucgaagagagagacuuugugcccggagaaaauaggaucgcuaacauucaagaugcgaucuggaacucccggaagauuguauguuuagucucacgccauuuccucagagacggcuggugccuggaggcauucaguuacgcccaggggaggugucuuagcgaccugaacucggcuuugaucauggugguugugggaucccucucucaguaucagcugaugaaacaccaaagcauacgugguuuuguccagaagcagcaauaccuacgguggccugaggaucugcaggacgugggcugguuccuucacaaacucucacagcagauccugaagaaagaaaaggagaagaaaaaggauaauaauauuccauugcaaacgguagccacaaucaguuga

SEQ ID NO: 9660 - RNA, 2577 nt, Artificial Sequence
  derived and/or modified sequence opt4 from TLR5__Homo_sapiens__AAZ17472
augggcgaccaccuggaccugcugcugggcguggugcugauggccggccccguguucggcauccccagcugcagcuucgacggcagaaucgccuucuacagauucugcaaccugacccaggugccccaggugcugaacaccaccgagagacugcugcugagcuucaacuacaucagaaccgugaccgccagcagcuuccccuuccuggagcagcugcagcugcuggagcugggcagccaguacaccccccugaccaucgacaaggaggccuucagaaaccugcccaaccugagaauccuggaccugggcagcagcaagaucuacuuccugcaccccgacgccuuccagggccuguuccaccuguucgagcugagacuguacuucugcggccugagcgacgccgugcugaaggacggcuacuucagaaaccugaaggcccugaccagacuggaccugagcaagaaccagaucagaagccuguaccugcaccccagcuucggcaagcugaacagccugaagagcaucgacuucagcagcaaccagaucuuccuggugugcgagcacgagcuggagccccugcagggcaagacccugagcuucuucagccuggccgccaacagccuguacagcagagugagcguggacuggggcaagugcaugaaccccuucagaaacauggugcuggagauccuggacgugagcggcaacggcuggaccguggacaucaccggcaacuucaccaacgccaucagcaagagccaggccuucagccugauccuggcccaccacaucaugggcgccggcuucggcuuccacaacaucaaggaccccgaccagaacaccuucgccggccuggccagaagcagcgugagacaccuggaccugagccacggcuucguguucagccugaacagcagaguguucgagacccugaaggaccugaaggugcugaaccuggccuacaacaagaucaacaagaucgccgacgaggccuucuacggccuggacaaccugcaggugcugaaccugagcuacaaccugcugggcgagcuguacagcagcaacuucuacggccugcccaagguggccuacaucgaccugcagaagaaccacaucgccaucauccaggaccagaccuucaaguuccuggagaagcugcagacccuggaccugagagacaacgcccugaccaccauccacuucauccccagcauccccgacaucuuccugagcggcaacaagcuggugacccugcccaagaucaaccugaccgccaaccugauccaccugagcgagaacagacuggagaaccuggacauccuguacuuccugcugagagugccccaccugcagauccugauccugaaccagaacagauucagcagcugcagcggcgaccagacccccagcgagaaccccagccuggagcagcuguuccugggcgagaacaugcugcagcuggccugggagaccgagcugugcugggacguguucgagggccugagccaccugcaggugcuguaccugaaccacaacuaccugaacagccugccccccggcguguucagccaccugaccgcccugagaggccugagccugaacagcaacagacugaccgugcugagccacaacgaccugcccgccaaccuggagauccuggacaucagcagaaaccagcugcuggcccccaaccccgacguguucgugagccugagcgugcuggacaucacccacaacaaguucaucugcgagugcgagcugagcaccuucaucaacuggcugaaccacaccaacgugaccaucgccggcccccccgccgacaucuacugcguguaccccgacagcuucagcggcgugagccuguucagccugagcaccgagggcugcgacgaggaggaggugcugaagagccugaaguucagccuguucuucgugugcaccgugacccugacccuguuccugaugaccauccugaccgugaccaaguucagaggcuucugcuucaucugcuacaagaccgcccagagacugguguucaaggaccacccccagggcaccgagcccgacauguacaaguacgacgccuaccugugcuucagcagcaaggacuucaccugggugcagaacgcccugcugaagcaccuggacacccaguacagcgaccagaacagauucaaccugugcuucgaggagagagacuucgugcccggcgagaacagaaucgccaacauccaggacgccaucuggaacagcagaaagaucgugugccuggugagcagacacuuccugagagacggcuggugccuggaggccuucagcuacgcccagggcagaugccugagcgaccugaacagcgcccugaucauggugguggugggcagccugagccaguaccagcugaugaagcaccagagcaucagaggcuucgugcagaagcagcaguaccugagauggcccgaggaccugcaggacgugggcugguuccugcacaagcugagccagcagauccugaagaaggagaaggagaagaagaaggacaacaacaucccccugcagaccguggccaccaucagcuga

SEQ ID NO: 9661 - RNA, 2577 nt, Artificial Sequence
  derived and/or modified sequence opt5 from TLR5__Homo_sapiens__AAZ17472
augggcgaccaccuggaucuccugcuuggggugguccugauggccggacccguuuucggcaucccuagcugcuccuuugacgggagaauugcuuucuaccgguuuuguaaccucacccaggugccgcaagugcugaauacaacggagcgccuucugcucucuuucaacuauaucagaaccgucacagccagcuccuuucccuuccuggaacagcugcagcuccuggagcuuggaucucaguacaccccucugacaauugauaaggaagcguuucggaaucuccccaaccugcgcauccuugaccugggcagcuccaaaauuuauuuccuccauccugaugcuuuucaagggcuguuccaccuguuugagcucagacuguacuucugcggacuuucugacgccgugcugaaggauggcuauuuucggaaucucaaagcccugacccgccuugaccugagcaagaaccagaucagaucccucuaccugcaucccagcuucggcaaacucaauucucucaaguccaucgauuucagcucuaaccagauuuuucugguuugugaacacgagcuugagccucugcaggggaagacacucuccuucuuuagccuggcugccaauucucuuuauucccgggugagcgucgacuggggaaaaugcaugaacccguuccgcaauauggugcuggaaauccucgauguuuccggcaacggguggaccguggacauuacgggaaauuuuaccaacgcuaucucuaagagccaagccuucucccugauucuggcgcaucacaucaugggcgccggguuuggauuccacaauauuaaagaucccgaccagaacacauuugcuggccucgccagaagcucuguccggcaucuggaccuuucccacggcuucguguuuagccugaacucucgcguguucgagacccucaaggaucugaaaguccugaaucuugcuuacaacaagaucaauaagaucgccgacgaagcguuuuacgggcucgauaaccugcagguucugaaucucagcuauaaccugcuuggagagcuguacuccucuaauuucuauggccucccuaaaguggccuacauugaccugcagaagaaccauaucgcuauuauccaagaucagacauucaaauuucuggagaagcugcagacccucgaccugagagauaaugcccugacgacaauucacuucauccccagcaucccugacauuuuucucuccgggaacaaacuggugacccuucccaagaucaaucugacagcuaaccucauucaccugagcgaaaaucggcuggagaaccuugauauccucuauuuccugcugcgcgucccgcaucuccaaauucugauccuuaaucagaacagauuuucuuccuguagcggagaccagaccccuucugaaaaccccucccuggagcagcuguuccugggcgaaaauaugcugcaacuugccugggagaccgagcucugcugggauguguuugaagggcugagccaccuucagguucucuaccugaaccauaauuaucuuaacucccugccucccggaguguucucucaccucacagcccugcggggccugagccuuaauuccaacagacugacgguccucucucauaaugaccugcccgcuaaccucgagauccuggacauuagccgcaaucagcuucuggcgccuaacccggauguguuuguuucccucagcgugcuggacaucacccacaauaaauucauuugugaaugcgagcugucuacauuuaucaacuggcuuaaucacaccaacgucacaauugccgggcccccugcugauaucuacuguguguaccccgacuccuucagcggcgucucucuguuuucccucagcaccgaaggaugcgaugaggaggaagugcugaagucucucaaguucagccuguucuuuguuuguacggugacacuuacccuguuccucaugaccauucugacagucaccaaauuucggggcuucugcuuuaucugcuauaagacagcccagagacugguguucaaagaccauccucaagggacggagcccgauauguacaaguaugacgccuaccuuuguuuuuccagcaaagauuucaccuggguucagaaugcucugcucaagcaccuggacacacaguauucugaucagaaccgcuuuaaccucugcuucgaggaacgggacuuugugccgggagaaaauagaaucgccaacauucaagaugcgaucuggaacucccgcaagauugucugucuggugagccggcauuuccuuagagacggcuggugccuggaggcuuucuccuacgcccaggggcgcugucugucugaccucaauagcgcccugaucauggugguugucggcucccuuucucaguaucagcugaugaaacaccaaagcauucggggauuugugcagaagcagcaauaccucagauggccugaggaucugcaggacgugggcugguuccuccacaaacugucccagcagauccuuaagaaagaaaaggagaagaaaaaggauaauaacaucccccugcaaaccgucgcuacaauuucuuga

SEQ ID NO: 9662 - protein, 858 aa, Artificial Sequence [sequence omitted]

SEQ ID NO: 9663 - RNA, 2577 nt, Artificial Sequence
  TLR5__Homo_sapiens__AAZ17473
augggagaccaccuggaccuucuccuaggaguggugcucauggccgguccuguguuuggaauuccuuccugcuccuuugauggccgaauagccuuuuaucguuucugcaaccucacccaggucccccagguccucaacaccacugagaggcuccugcugagcuucaacuauaucaggacagucacugcuucauccuuccccuuucuggaacagcugcagcugcuggagcucgggagccaguauacccccuugacuauugacaaggaggccuucagaaaccugcccaaccuuagaaucuuggaccugggaaguaguaagauauacuucuugcauccagaugcuuuucagggacuguuccaucuguuugaacuuagacuguauuucuguggucucucugaugcuguauugaaagaugguuauuucagaaauuuaaaggcuuuaacucgcuuggaucuauccaaaaaucagauucguagccuuuaccuucauccuucauuugggaaguugaauuccuuaaaguccauagauuuuuccuccaaccaaauauuccuuguaugugaacaugagcucgagccccuacaagggaaaacgcucuccuuuuuuagccucgcagcuaauagcuuguauagcagagucucaguggacuggggaaaauguaugaacccauucagaaacauggugcuggagauacuagauguuucuggaaauggcuggacaguggacaucacaggaaacuuuagcaaugccaucagcaaaagccaggccuucucuuugauucuugcccaccacaucaugggugccggguuuggcuuccauaacaucaaagauccugaccagaacacauuugcuggccuggccagaaguucagugagacaccuggaucuuucacauggguuugucuucucccugaacucacgagucuuugagacacucaaggauuugaagguucugaaccuugccuacaacaagauaaauaagauugcagaugaagcauuuuacggacuugacaaccuccaaguucucaauuugucauauaaccuucugggggaacuuuacaguucgaauuucuauggacuaccuaagguagccuacauugauuugcaaaagaaucacauugcaauaauucaagaccaaacauucaaauuccuggaaaaauuacagaccuuggaucuccgagacaaugcucuuacaaccauucauuuuauuccaagcauacccgauaucuucuugaguggcaauaaacuagugacuuugccaaagaucaaccuuacagcgaaccucauccacuuaucagaaaacaggcuagaaaaucuagauauucucuacuuucuccuacggguaccucaucuccagauucucauuuuaaaucaaaaucgcuucuccuccuguaguggagaucaaaccccuucagagaaucccagcuuagaacagcuuuuccuuggagaaaauauguugcaacuugccugggaaacugagcucuguugggauguuuuugagggacuuucucaucuucaaguucuguauuugaaucauaacuaucuuaauucccuuccaccaggaguauuuagccaucugacugcauuaaggggacuaagccucaacuccaacaggcugacaguucuuucucacaaugauuuaccugcuaauuuagagauccuggacauauccaggaaccagcuccuagcuccuaauccugauguauuuguaucacuuagugucuuggauauaacucauaacaaguucauuugugaaugugaacuuagcacuuuuaucaguuggcuuaaucacaccaaugucacuauagcugggccuccugcagacauauauuguguguacccugacucguucucugggguuucccucuucucucuuuccacggaagguugugaugaagaggaagucuuaaagucccuaaaguucucccuuuucuuuguaugcacugucacucugacucuguuccucaugaccauccucacagucacaaaguuccggggcuucuguuuuaucuguuauaagacagcccagagacugguguucaaggaccauccccagggcacagaaccugauauguacaaauaugaugccuauuugugcuucagcagcaaagacuucacaugggugcagaaugcuuugcucaaacaccuggacacucaauacagugaccaaaacagauucaaccugugcuuugaagaaagagacuuugucccaggagaaaaccgcauugccaauauccaggaugccaucuggaacaguagaaagaucguuugucuugugagcagacacuuccuuagagauggcuggugccuugaagccuucaguuaugcccagggcaggugcuuaucugaccuuaacagugcucucaucaugguggugguuggguccuugucccaguaccaguugaugaaacaucaauccaucagaggcuuuguacagaaacagcaguauuugagguggccugaggaucuccaggauguuggcugguuucuucauaaacucucucaacagauacuaaagaaagaaaaagaaaagaagaaagacaauaacauuccguugcaaacuguagcaaccaucuccuaa

SEQ ID NO: 9664 - RNA, 2577 nt, Artificial Sequence
  derived and/or modified sequence opt1 from TLR5__Homo_sapiens__AAZ17473
augggcgaccaccuggaccuccugcugggggugguccucauggccggccccguguucgggaucccgagcugcuccuucgacggccgcaucgccuucuaccgguucugcaaccugacccaggugccccagguccugaacaccacggagcgccuccugcugagcuucaacuacauccggaccgugaccgcguccagcuuccccuuccucgagcagcugcagcugcucgagcuggggucccaguacacgccccugaccaucgacaaggaggccuuccgcaaccucccgaaccugcggauccuggaccucggcagcuccaagaucuacuuccugcaccccgacgccuuccagggccuguuccaccucuucgagcugcgccuguacuucugcgggcucagcgacgccgugcugaaggacggcuacuuccggaaccugaaggcccucacccgccuggaccuguccaagaaccagauccggagccucuaccugcaccccuccuucgggaagcugaacagccucaaguccaucgacuucagcuccaaccagaucuuccuggucugcgagcacgagcuggagccccuccagggcaagacccugagcuucuucucccuggcggccaacagccucuacucccgcgugagcguggacugggggaagugcaugaacccguuccggaacaugguccuggagauccuggacgugagcggcaacggcuggaccguggacaucacggggaacuucuccaacgccaucagcaagucccaggccuucagccucauccuggcgcaccacaucaugggcgccggguucggcuuccacaacaucaaggaccccgaccagaacaccuucgccggccuggcccgcuccagcguccggcaccucgaccugucccacggguucguguucagccugaacucccgcguguucgagacccucaaggaccugaagguccugaaccuggccuacaacaagaucaacaagaucgcggacgaggccuucuacggccucgacaaccuccaggugcugaaccugagcuacaaccugcugggggagcucuacuccagcaacuucuacggccugcccaagguggccuacaucgaccugcagaagaaccacaucgccaucauccaggaccagaccuucaaguuccucgagaagcugcagacgcuggaccuccgggacaacgcccugaccaccauccacuucauccccuccaucccggacaucuuccugagcgggaacaagcucgucacccugcccaagaucaaccugacggcgaaccucauccaccuguccgagaaccgccuggagaaccucgacauccuguacuuccugcuccgggugccccaccuccagauccugauccugaaccagaaccgcuucagcuccugcagcggcgaccagacccccuccgagaacccgagccuggagcagcuguuccucggcgagaacaugcugcagcuggccugggagaccgagcucugcugggacguguucgaggggcugagccaccuccagguccuguaccugaaccacaacuaccugaacucccucccgcccggcguguucagccaccugaccgcccugcgggggcucucccugaacagcaaccgccugacggugcucucccacaacgaccugcccgccaaccuggagauccucgacaucagccggaaccagcugcuggcccccaaccccgacgucuucgugucccucagcguccuggacaucacccacaacaaguucaucugcgagugcgagcuguccaccuucaucagcuggcucaaccacaccaacgugacgaucgcgggcccgcccgccgacaucuacugcguguaccccgacuccuucagcggggucucccuguucagccuguccaccgagggcugcgacgaggaggaggugcucaagagccugaaguucucccuguucuucgugugcaccgucacccucacgcuguuccugaugaccauccucaccgugaccaaguuccgcggcuucugcuucaucugcuacaagacggcccagcgccugguguucaaggaccacccccaggggaccgagcccgacauguacaaguacgacgccuaccugugcuucagcagcaaggacuucaccuggguccagaacgcccuccugaagcaccuggacacccaguacuccgaccagaaccgguucaaccucugcuucgaggagcgcgacuucgugcccggcgagaaccggaucgcgaacauccaggacgccaucuggaacagccgcaagaucgugugccuggucucccggcacuuccugcgcgacggguggugccucgaggccuucagcuacgcccagggccggugccuguccgaccugaacagcgcgcucaucauggugguggucgggucccugagccaguaccagcugaugaagcaccaguccauccgcggcuucgugcagaagcagcaguaccuccgguggccggaggaccugcaggacgugggcugguuccugcacaagcucagccagcagauccugaagaaggagaaggagaagaagaaggacaacaacaucccccugcagacggucgccaccaucuccuga

SEQ ID NO: 9665 - RNA, 2577 nt, Artificial Sequence
  derived and/or modified sequence opt2 from TLR5__Homo_sapiens__AAZ17473
augggcgaccaccucgaccuccuccucggcgucguccucauggccggccccgucuucggcauccccuccugcuccuucgacggccgcaucgccuucuaccgcuucugcaaccucacccaggucccccagguccucaacaccaccgagcgccuccuccucuccuucaacuacauccgcaccgucaccgccuccuccuuccccuuccucgagcagcuccagcuccucgagcucggcucccaguacaccccccucaccaucgacaaggaggccuuccgcaaccuccccaaccuccgcauccucgaccucggcuccuccaagaucuacuuccuccaccccgacgccuuccagggccucuuccaccucuucgagcuccgccucuacuucugcggccucuccgacgccguccucaaggacggcuacuuccgcaaccucaaggcccucacccgccucgaccucuccaagaaccagauccgcucccucuaccuccaccccuccuucggcaagcucaacucccucaaguccaucgacuucuccuccaaccagaucuuccucgucugcgagcacgagcucgagccccuccagggcaagacccucuccuucuucucccucgccgccaacucccucuacucccgcgucuccgucgacuggggcaagugcaugaaccccuuccgcaacaugguccucgagauccucgacgucuccggcaacggcuggaccgucgacaucaccggcaacuucuccaacgccaucuccaagucccaggccuucucccucauccucgcccaccacaucaugggcgccggcuucggcuuccacaacaucaaggaccccgaccagaacaccuucgccggccucgcccgcuccuccguccgccaccucgaccucucccacggcuucgucuucucccucaacucccgcgucuucgagacccucaaggaccucaagguccucaaccucgccuacaacaagaucaacaagaucgccgacgaggccuucuacggccucgacaaccuccagguccucaaccucuccuacaaccuccucggcgagcucuacuccuccaacuucuacggccuccccaaggucgccuacaucgaccuccagaagaaccacaucgccaucauccaggaccagaccuucaaguuccucgagaagcuccagacccucgaccuccgcgacaacgcccucaccaccauccacuucauccccuccauccccgacaucuuccucuccggcaacaagcucgucacccuccccaagaucaaccucaccgccaaccucauccaccucuccgagaaccgccucgagaaccucgacauccucuacuuccuccuccgcgucccccaccuccagauccucauccucaaccagaaccgcuucuccuccugcuccggcgaccagacccccuccgagaaccccucccucgagcagcucuuccucggcgagaacaugcuccagcucgccugggagaccgagcucugcugggacgucuucgagggccucucccaccuccagguccucuaccucaaccacaacuaccucaacucccucccccccggcgucuucucccaccucaccgcccuccgcggccucucccucaacuccaaccgccucaccguccucucccacaacgaccuccccgccaaccucgagauccucgacaucucccgcaaccagcuccucgcccccaaccccgacgucuucgucucccucuccguccucgacaucacccacaacaaguucaucugcgagugcgagcucuccaccuucaucuccuggcucaaccacaccaacgucaccaucgccggcccccccgccgacaucuacugcgucuaccccgacuccuucuccggcgucucccucuucucccucuccaccgagggcugcgacgaggaggagguccucaagucccucaaguucucccucuucuucgucugcaccgucacccucacccucuuccucaugaccauccucaccgucaccaaguuccgcggcuucugcuucaucugcuacaagaccgcccagcgccucgucuucaaggaccacccccagggcaccgagcccgacauguacaaguacgacgccuaccucugcuucuccuccaaggacuucaccuggguccagaacgcccuccucaagcaccucgacacccaguacuccgaccagaaccgcuucaaccucugcuucgaggagcgcgacuucguccccggcgagaaccgcaucgccaacauccaggacgccaucuggaacucccgcaagaucgucugccucgucucccgccacuuccuccgcgacggcuggugccucgaggccuucuccuacgcccagggccgcugccucuccgaccucaacuccgcccucaucauggucgucgucggcucccucucccaguaccagcucaugaagcaccaguccauccgcggcuucguccagaagcagcaguaccuccgcuggcccgaggaccuccaggacgucggcugguuccuccacaagcucucccagcagauccucaagaaggagaaggagaagaagaaggacaacaacaucccccuccagaccgucgccaccaucuccuga

SEQ ID NO: 9666 - RNA, 2577 nt, Artificial Sequence
  derived and/or modified sequence opt3 from TLR5__Homo_sapiens__AAZ17473
augggcgaccaccuggaucuccuucuggggguggucuugauggccggacccguuuucgguaucccuagcugcuccuuugacggcagaauugcuuucuacagguuuuguaacuuaacccaggugccacaaguacugaauacaacugagcggcuacuccugucuuucaacuauauacgcacggugaccgcaucaaguuuuccguuccuugaacagcugcaguugcucgagcuggggagccaguacacaccccugacuaucgauaaggaagccuuucgaaaucucccuaacuuacguauucuggaccuuggauccucuaaaaucuauuucuugcauccagaugcguuucaaggccuguuccaccuauuugagcucagacuguacuucugcggucuuucggacgcuguccugaaggauggguauuuuaggaauuugaaagcccucacccggcuggacuuaucaaagaaccagauucgcagccuguaccuccaucccaguuucggaaaacuuaauucccugaagucuaucgauuucagcuccaaccagauauuuuuggugugugaacacgagcuagagccucugcagggcaagacacucucauucuuuagucuggcagccaauagccuuuauucuagaguuuccguggacuggggcaaaugcaugaacccauucaggaauaugguccuggaaaucuuggaugugucagggaacggauggaccguagacauuacugguaauuuuagcaacgcuaucaguaagucucaagcauucucccucauucuggcccaucacaucaugggcgcuggguuuggauuccacaauauaaaagaucccgaccagaacacauuugccggcuuagcgcggagcucgguucgccaucuggaccuaucucacgguuucguguuuucccucaacucacgagucuucgagacccugaaggaucuuaaaguguugaaucuggcauacaacaagauuaauaagaucgccgacgaggcuuuuuacgggcucgauaaccugcaagugcuuaaucugaguuauaacuugcucggagaacuguacagcuccaauuucuauggcuuaccuaaagucgccuacauugaccugcagaagaaccauaucgcaaucauucaggaucagacguucaaauuucuagagaagcuccagacucuggaccuuagagauaaugcuuugaccacaauacacuucaucccaucuauuccggacaucuuucugagcggcaacaaacucguuacucugcccaagauaaauuuaaccgccaaccugauucaccuuucagaaaauagguuggagaaccucgauauccuguauuuccuacugcgggugccucaucuccaaauccugauucuuaaucagaaccguuuuaguuccuguagcggggaccagacaccaucugaaaaccccucauuggagcagcuguucuuaggagaaaauaugcuccaacuggcgugggagaccgagcuuugcugggauguauuugaaggucugagucaccuccagguguuguaccugaaccauaauuaucuaaacagccugccuccaggcgucuucucccaccucacggcccugcgcgggcuuucuuugaacucgaauagacugacuguguuaagccauaaugaccuccccgcaaaccuggagauccuugacauuuccaggaaucagcugcuagcuccgaacccugauguuuuugugucacucaguguccuggacauaacacacaauaaauucaucugugaaugcgaguugucuaccuuuauuagcuggcugaaccacacuaaugugacaaucgccggacccccagcugauaucuacuguguauacccugacuccuucucaggcguuagcuuauuuucucucuccaccgaagguugcgaugaggaggaagugcugaagagucuuaaguucagccuguucuuugucuguacggugaccuugacacucuuccugaugacuauucuaaccgucacaaaauuucggggguucugcuuuauaugcuauaagacugcccagcgacugguguucaaagaccauccccaaggcaccgagccagauauguacaaguaugacgcauaccuuuguuuuucuuccaaagauuucacauggguucagaacgcccuccugaagcacuuggacacccaguauucagaucagaaucgcuuuaaccugugcuucgaagagagagacuuugugcccggagaaaacaggaucgcuaauauucaagaugcgaucuggaacagucggaagauuguauguuuagucagccgccauuuccucagagacggcuggugccuggaggcauucucguacgcccaggggaggugucuuuccgaccugaacucugcuuugaucauggugguugugggaagccucucacaguaucagcugaugaaacaccaaaguauacgugguuuuguccagaagcagcaauaccuacgguggccugaggaucugcaggacgugggcugguuccuucacaaacucucccagcagauccugaagaaagaaaaggagaagaaaaaggauaauaauauuccauugcaaacuguagccacgaucucuuga

SEQ ID NO: 9667 - RNA, 2577 nt, Artificial Sequence
  derived and/or modified sequence opt4 from TLR5__Homo_sapiens__AAZ17473
augggcgaccaccuggaccugcugcugggcguggugcugauggccggccccguguucggcauccccagcugcagcuucgacggcagaaucgccuucuacagauucugcaaccugacccaggugccccaggugcugaacaccaccgagagacugcugcugagcuucaacuacaucagaaccgugaccgccagcagcuuccccuuccuggagcagcugcagcugcuggagcugggcagccaguacaccccccugaccaucgacaaggaggccuucagaaaccugcccaaccugagaauccuggaccugggcagcagcaagaucuacuuccugcaccccgacgccuuccagggccuguuccaccuguucgagcugagacuguacuucugcggccugagcgacgccgugcugaaggacggcuacuucagaaaccugaaggcccugaccagacuggaccugagcaagaaccagaucagaagccuguaccugcaccccagcuucggcaagcugaacagccugaagagcaucgacuucagcagcaaccagaucuuccuggugugcgagcacgagcuggagccccugcagggcaagacccugagcuucuucagccuggccgccaacagccuguacagcagagugagcguggacuggggcaagugcaugaaccccuucagaaacauggugcuggagauccuggacgugagcggcaacggcuggaccguggacaucaccggcaacuucagcaacgccaucagcaagagccaggccuucagccugauccuggcccaccacaucaugggcgccggcuucggcuuccacaacaucaaggaccccgaccagaacaccuucgccggccuggccagaagcagcgugagacaccuggaccugagccacggcuucguguucagccugaacagcagaguguucgagacccugaaggaccugaaggugcugaaccuggccuacaacaagaucaacaagaucgccgacgaggccuucuacggccuggacaaccugcaggugcugaaccugagcuacaaccugcugggcgagcuguacagcagcaacuucuacggccugcccaagguggccuacaucgaccugcagaagaaccacaucgccaucauccaggaccagaccuucaaguuccuggagaagcugcagacccuggaccugagagacaacgcccugaccaccauccacuucauccccagcauccccgacaucuuccugagcggcaacaagcuggugacccugcccaagaucaaccugaccgccaaccugauccaccugagcgagaacagacuggagaaccuggacauccuguacuuccugcugagagugccccaccugcagauccugauccugaaccagaacagauucagcagcugcagcggcgaccagacccccagcgagaaccccagccuggagcagcuguuccugggcgagaacaugcugcagcuggccugggagaccgagcugugcugggacguguucgagggccugagccaccugcaggugcuguaccugaaccacaacuaccugaacagccugccccccggcguguucagccaccugaccgcccugagaggccugagccugaacagcaacagacugaccgugcugagccacaacgaccugcccgccaaccuggagauccuggacaucagcagaaaccagcugcuggcccccaaccccgacguguucgugagccugagcgugcuggacaucacccacaacaaguucaucugcgagugcgagcugagcaccuucaucagcuggcugaaccacaccaacgugaccaucgccggcccccccgccgacaucuacugcguguaccccgacagcuucagcggcgugagccuguucagccugagcaccgagggcugcgacgaggaggaggugcugaagagccugaaguucagccuguucuucgugugcaccgugacccugacccuguuccugaugaccauccugaccgugaccaaguucagaggcuucugcuucaucugcuacaagaccgcccagagacugguguucaaggaccacccccagggcaccgagcccgacauguacaaguacgacgccuaccugugcuucagcagcaaggacuucaccugggugcagaacgcccugcugaagcaccuggacacccaguacagcgaccagaacagauucaaccugugcuucgaggagagagacuucgugcccggcgagaacagaaucgccaacauccaggacgccaucuggaacagcagaaagaucgugugccuggugagcagacacuuccugagagacggcuggugccuggaggccuucagcuacgcccagggcagaugccugagcgaccugaacagcgcccugaucauggugguggugggcagccugagccaguaccagcugaugaagcaccagagcaucagaggcuucgugcagaagcagcaguaccugagauggcccgaggaccugcaggacgugggcugguuccugcacaagcugagccagcagauccugaagaaggagaaggagaagaagaaggacaacaacaucccccugcagaccguggccaccaucagcuga

SEQ ID NO: 9668 - RNA, 2577 nt, Artificial Sequence
  derived and/or modified sequence opt5 from TLR5__Homo_sapiens__AAZ17473
augggcgaccaccuggaucuccugcuuggggugguccugauggccggacccguuuucggcaucccuagcugcuccuuugacgggagaauugcuuucuaccgguuuuguaaccucacccaggugccgcaagugcugaauacaacggagcgccuucugcucucuuucaacuauaucagaaccgucacagccagcuccuuucccuuccuggaacagcugcagcuccuggagcuuggaucucaguacaccccucugacaauugauaaggaagcguuucggaaucuccccaaccugcgcauccuugaccugggcagcuccaaaauuuauuuccuccauccugaugcuuuucaagggcuguuccaccuguuugagcucagacuguacuucugcggacuuucugacgccgugcugaaggauggcuauuuucggaaucucaaagcccugacccgccuugaccugagcaagaaccagaucagaucccucuaccugcaucccagcuucggcaaacucaauucucucaaguccaucgauuucagcucuaaccagauuuuucugguuugugaacacgagcuugagccucugcaggggaagacacucuccuucuuuagccuggcugccaauucucuuuauucccgggugagcgucgacuggggaaaaugcaugaacccguuccgcaauauggugcuggaaauccucgauguuuccggcaacggguggaccguggacauuacgggaaauuuuucuaacgcuaucagcaagucccaagccuucagccugauucuggcgcaucacaucaugggcgccggguuuggauuccacaauauuaaagaucccgaccagaacaccuuugcuggccucgccagaucuuccguccggcaucuggaccuuagccacggcuucguguuuucucugaacagccgcguguucgagacacucaaggaucugaaaguccugaaucuugcuuacaacaagaucaauaagaucgccgacgaagcguuuuacgggcucgauaaccugcagguucugaaucucuccuauaaccugcuuggagagcuguacucuagcaauuucuauggccucccuaaaguggccuacauugaccugcagaagaaccauaucgcuauuauccaagaucagaccuucaaauuucuggagaagcugcagacacucgaccugagagauaaugcccugaccacgauucacuucauccccuccaucccugacauuuuucucagcgggaacaaacuggugacacuucccaagaucaaucugaccgcuaaccucauucaccugucugaaaaucggcuggagaaccuugauauccucuauuuccugcugcgcgucccgcaucuccaaauucugauccuuaaucagaacagauuuuccagcuguucuggagaccagacaccuuccgaaaaccccagccuggagcagcuguuccugggcgaaaauaugcugcaacuugccugggagaccgagcucugcugggauguguuugaagggcugucccaccuucagguucucuaccugaaccauaauuaucuuaacucucugccucccggaguguucagccaccucaccgcccugcggggccugucccuuaauucuaacagacugacaguccucagccauaaugaccugcccgcuaaccucgagauccuggacauuucccgcaaucagcuucuggcgccuaacccggauguguuuguuagccucucugugcuggacaucacgcacaauaaauucauuugugaaugcgagcuguccaccuuuaucagcuggcuuaaccacacaaaugucaccauugccgggcccccugcugauaucuacuguguguaccccgacucuuucuccggcgucagccuguuuucucucagcacagaaggaugcgaugaggaggaagugcugaagucccucaaguucagccuguucuuuguuuguaccgugacgcuuacacuguuccucaugaccauucugaccgucacaaaauuucggggcuucugcuuuaucugcuauaagaccgcccagagacugguguucaaagaccauccucaagggacagagcccgauauguacaaguaugacgccuaccuuuguuuuucuuccaaagauuucacguggguucagaacgcucugcucaagcaccuggacacccaguauagcgaucagaaucgcuuuaaccucugcuucgaggaacgggacuuugugccgggagaaaacagaaucgccaauauucaagaugcgaucuggaacucccgcaagauugucugucuggugucucggcauuuccuuagagacggcuggugccuggaggcuuucagcuacgcccaggggcgcugucuguccgaccucaauucugcccugaucauggugguugucggcagccuuucccaguaucagcugaugaaacaccaaucuauucggggauuugugcagaagcagcaauaccucagauggccugaggaucugcaggacgugggcugguuccuccacaaacugagccagcagauccuuaagaaagaaaaggagaagaaaaaggauaacaauaucccccugcaaacagucgcuaccauuuccuga

SEQ ID NO: 9669 - protein, 796 aa, Artificial Sequence [sequence omitted]

SEQ ID NO: 9670 - RNA, 2391 nt, Artificial Sequence
  TLR6__Homo_sapiens__ABW37065
augaccaaagacaaagaaccuauuguuaaaagcuuccauuuuguuugccuuaugaucauaauaguuggaaccagaauccaguucuccgacggaaaugaauuugcaguagacaagucaaaaagaggucuuauucauguuccaaaagaccuaccgcugaaaaccaaagucuuagauaugucucagaacuacaucgcugagcuucaggucucugacaugagcuuucuaucagaguugacaguuuugagacuuucccauaacagaauccagcuacuugauuuaaguguuuucaaguucaaccaggauuuagaauauuuggauuuaucucauaaucaguugcaaaagauauccugccauccuauugugaguuucaggcauuuagaucucucauucaaugauuucaaggcccugcccaucuguaaggaauuuggcaacuuaucacaacugaauuucuugggauugagugcuaugaagcugcaaaaauuagauuugcugccaauugcucacuugcaucuaaguuauauccuucuggauuuaagaaauuauuauauaaaagaaaaugagacagaaagucuacaaauucugaaugcaaaaacccuucaccuuguuuuucacccaacuaguuuauucgcuauccaagugaacauaucaguuaauacuuuagggugcuuacaacugacuaauauuaaauugaaugaugacaacugucaaguuuucauuaaauuuuuaucagaacucaccagagguccaaccuuacugaauuuuacccucaaccacauagaaacgacuuggaaaugccuggucagagucuuucaauuucuuuggcccaaaccuguggaauaucucaauauuuacaauuuaacaauaauugaaagcauucgugaagaagauuuuacuuauucuaaaacgacauugaaagcauugacaauagaacauaucacgaaccaaguuuuucuguuuucacagacagcuuuguacaccguguuuucugagaugaacauuaugauguuaaccauuucagauacaccuuuuauacacaugcuguguccucaugcaccaagcacauucaaguuuuugaacuuuacgcagaacguuuucacagauaguauuuuugaaaaauguuccacguuaguuaaauuggagacacuuaucuuacaaaagaauggauuaaaagaccuuuucaaaguaggucucaugacgaaggauaugccuucuuuggaaauacuggauguuagcuggaauucuuuggaaucugguagacauaaggaaaacugcacuuggguugagaguauagugguguuaaauuugucuucaaauaugcuuacugacucuguuuucagauguuuaccucccaggaucaagguacuugaucuucacagcaauaaaauaaagagcguuccuaaacaagucuuaaaacuggaagcuuugcaagaacucaauguugcuuucaauucuuuaacugaccuuccuggauguggcagcuuuagcagccuuucuguauugaucauugaucacaauucaguuucccacccaucggcugauuucuuccagagcugccagaagaugaggucaauaaaagcaggggacaauccauuccaauguaccugugagcuaagagaauuugucaaaaauauagaccaaguaucaagugaaguguuagagggcuggccugauucuuauaagugugacuacccagaaaguuauagaggaagcccacuaaaggacuuucacaugucugaauuauccugcaacauaacucugcugaucgucaccaucggugccaccaugcugguguuggcugugacugugaccucccucugcaucuacuuggaucugcccugguaucucaggauggugugccaguggacccagacucggcgcagggccaggaacauacccuuagaagaacuccaaagaaaccuccaguuucaugcuuuuauuucauauagugaacaugauucugccugggugaaaagugaauugguaccuuaccuagaaaaagaagauauacagauuugucuucaugagagaaacuuugucccuggcaagagcauuguggaaaauaucaucaacugcauugagaagaguuacaaguccaucuuuguuuugucucccaacuuuguccagagugaguggugccauuacgaacucuauuuugcccaucacaaucucuuucaugaaggaucuaauaacuuaauccucaucuuacuggaacccauuccacagaacagcauucccaacaaguaccacaagcugaaggcucucaugacgcagcggacuuauuugcaguggcccaaggagaaaagcaaacgugggcucuuuugggcuaacauuagagccgcuuuuaauaugaaauuaacacuagucacugaaaacaaugaugugaaaucuuaa

SEQ ID NO: 9671 - RNA, 2391 nt, Artificial Sequence
  derived and/or modified sequence opt1 from TLR6__Homo_sapiens__ABW37065
augaccaaggacaaggagcccaucgucaagagcuuccacuucgugugccugaugaucaucaucgugggcacccgcauccaguucuccgacgggaacgaguucgccguggacaagagcaagcggggccucauccacgucccgaaggaccugccccugaagacgaaggugcucgacaugucccagaacuacaucgccgagcuccaggugagcgacauguccuuccugagcgagcugaccguccugcgccugucccacaaccggauccagcuccuggaccugagcguguucaaguucaaccaggaccucgaguaccuggaccugucccacaaccagcuccagaagaucagcugccaccccaucguguccuuccgccaccuggaccugagcuucaacgacuucaaggcgcuccccaucugcaaggaguucgggaaccugucccagcugaacuuccucggccugagcgccaugaagcugcagaagcucgaccugcugccgaucgcccaccuccaccuguccuacauccugcucgaccugcggaacuacuacaucaaggagaacgagaccgagagccugcagauccucaacgccaagacccugcaccuggucuuccaccccacgucccucuucgccauccaggugaacaucagcgugaacacccuggggugccugcagcucaccaacaucaagcugaacgacgacaacugccaggucuucaucaaguuccuguccgagcucacccgcggccccacgcugcugaacuucacccucaaccacaucgagaccaccuggaagugccuggugcggguguuccaguuccuguggcccaagccggucgaguaccucaacaucuacaaccugacgaucaucgagagcauccgcgaggaggacuucaccuacagcaagaccacccugaaggcgcugacgaucgagcacaucaccaaccagguguuccucuucucccagaccgcccuguacaccguguucagcgagaugaacaucaugaugcugacgaucuccgacacccccuucauccacaugcucugcccccacgcccccagcaccuucaaguuccugaacuucacccagaacgucuucacggacuccaucuucgagaagugcagcacccuggugaagcucgagacccugauccugcagaagaacggccucaaggaccuguucaagguggggcugaugaccaaggacaugccgucccucgagauccuggacgucagcuggaacucccuggagagcggccggcacaaggagaacugcacguggguggaguccaucgugguccucaaccugagcuccaacaugcugaccgacagcguguuccgcugccucccgccccggaucaagguccuggaccugcacuccaacaagaucaagagcgugcccaagcagguccucaagcuggaggcccugcaggagcucaacguggcguucaacucccugaccgaccugcccgggugcggcagcuucuccagccucagcgugcugaucaucgaccacaacuccgugagccaccccuccgccgacuucuuccagagcugccagaagaugcgcuccaucaaggccggggacaaccccuuccagugcacgugcgagcugcgggaguucgucaagaacaucgaccaggugagcuccgaggugcucgagggcuggcccgacagcuacaagugcgacuacccggaguccuaccgcggcagcccccugaaggacuuccacauguccgagcugagcugcaacaucacccuccugaucgucaccaucggggccaccaugcuggugcucgccgugaccgucacgucccugugcaucuaccuggaccuccccugguaccugcggauggugugccaguggacccagacccgccggcgcgcgcggaacaucccccuggaggagcuccagcgcaaccugcaguuccacgccuucaucagcuacuccgagcacgacagcgccugggugaaguccgagcuggucccguaccucgagaaggaggacauccagaucugccugcacgagcggaacuucgugcccggcaagagcaucguggagaacaucaucaacugcaucgagaaguccuacaagagcaucuucguccugagccccaacuucgugcaguccgaguggugccacuacgagcucuacuucgcccaccacaaccuguuccacgaggggagcaacaaccugauccucauccugcuggagcccaucccgcagaacuccauccccaacaaguaccacaagcucaaggcccugaugacccagcgcaccuaccugcaguggcccaaggagaaguccaagcgcggccucuucugggcgaacauccgggccgccuucaacaugaagcugacgcuggugaccgagaacaacgacgucaagagcuga

SEQ ID NO: 9672 - RNA, 2391 nt, Artificial Sequence
  derived and/or modified sequence opt2 from TLR6__Homo_sapiens__ABW37065
augaccaaggacaaggagcccaucgucaaguccuuccacuucgucugccucaugaucaucaucgucggcacccgcauccaguucuccgacggcaacgaguucgccgucgacaaguccaagcgcggccucauccacguccccaaggaccucccccucaagaccaagguccucgacaugucccagaacuacaucgccgagcuccaggucuccgacauguccuuccucuccgagcucaccguccuccgccucucccacaaccgcauccagcuccucgaccucuccgucuucaaguucaaccaggaccucgaguaccucgaccucucccacaaccagcuccagaagaucuccugccaccccaucgucuccuuccgccaccucgaccucuccuucaacgacuucaaggcccuccccaucugcaaggaguucggcaaccucucccagcucaacuuccucggccucuccgccaugaagcuccagaagcucgaccuccuccccaucgcccaccuccaccucuccuacauccuccucgaccuccgcaacuacuacaucaaggagaacgagaccgagucccuccagauccucaacgccaagacccuccaccucgucuuccaccccaccucccucuucgccauccaggucaacaucuccgucaacacccucggcugccuccagcucaccaacaucaagcucaacgacgacaacugccaggucuucaucaaguuccucuccgagcucacccgcggccccacccuccucaacuucacccucaaccacaucgagaccaccuggaagugccucguccgcgucuuccaguuccucuggcccaagcccgucgaguaccucaacaucuacaaccucaccaucaucgaguccauccgcgaggaggacuucaccuacuccaagaccacccucaaggcccucaccaucgagcacaucaccaaccaggucuuccucuucucccagaccgcccucuacaccgucuucuccgagaugaacaucaugaugcucaccaucuccgacacccccuucauccacaugcucugcccccacgcccccuccaccuucaaguuccucaacuucacccagaacgucuucaccgacuccaucuucgagaagugcuccacccucgucaagcucgagacccucauccuccagaagaacggccucaaggaccucuucaaggucggccucaugaccaaggacaugcccucccucgagauccucgacgucuccuggaacucccucgaguccggccgccacaaggagaacugcaccugggucgaguccaucgucguccucaaccucuccuccaacaugcucaccgacuccgucuuccgcugccuccccccccgcaucaagguccucgaccuccacuccaacaagaucaaguccguccccaagcagguccucaagcucgaggcccuccaggagcucaacgucgccuucaacucccucaccgaccuccccggcugcggcuccuucuccucccucuccguccucaucaucgaccacaacuccgucucccaccccuccgccgacuucuuccaguccugccagaagaugcgcuccaucaaggccggcgacaaccccuuccagugcaccugcgagcuccgcgaguucgucaagaacaucgaccaggucuccuccgagguccucgagggcuggcccgacuccuacaagugcgacuaccccgaguccuaccgcggcuccccccucaaggacuuccacauguccgagcucuccugcaacaucacccuccucaucgucaccaucggcgccaccaugcucguccucgccgucaccgucaccucccucugcaucuaccucgaccuccccugguaccuccgcauggucugccaguggacccagacccgccgccgcgcccgcaacaucccccucgaggagcuccagcgcaaccuccaguuccacgccuucaucuccuacuccgagcacgacuccgccugggucaaguccgagcucguccccuaccucgagaaggaggacauccagaucugccuccacgagcgcaacuucguccccggcaaguccaucgucgagaacaucaucaacugcaucgagaaguccuacaaguccaucuucguccucucccccaacuucguccaguccgaguggugccacuacgagcucuacuucgcccaccacaaccucuuccacgagggcuccaacaaccucauccucauccuccucgagcccaucccccagaacuccauccccaacaaguaccacaagcucaaggcccucaugacccagcgcaccuaccuccaguggcccaaggagaaguccaagcgcggccucuucugggccaacauccgcgccgccuucaacaugaagcucacccucgucaccgagaacaacgacgucaaguccuga

SEQ ID NO: 9673 - RNA, 2391 nt, Artificial Sequence
  derived and/or modified sequence opt3 from TLR6__Homo_sapiens__ABW37065
augaccaaggacaaagagcccaucgucaagagcuuccacuuugugugccugaugauuauaaucguuggcacaaggauucaguucuccgaugggaacgaauuugccguggacaaaucuaagagaggacucauccauguaccuaaagaucuuccacugaagacuaagguguuggacaugucacaaaauuacauugcugaguuacaggucagugauaugagcuuccuguccgaacuaacggugcuccggcugucucacaaccgcauccagcuucuggacuugucgguuuuuaaauucaaucaggaucucgaguaucuggaccugucacauaaccaacuccagaagauaagcugucacccgaucgugaguuuucgacauuuagaucuguccuucaaugacuuuaaagcacuucccauuugcaaggaguucgguaacuugucucagcugaauuuucuaggccucagcgccaugaaacugcagaaacuugaucuguugccuaucgcgcaccuccaccuguccuacauuuuacuggaccuccguaacuauuacaucaaggaaaaugagaccgaaucacuucaaauacugaacgcuaaaacauugcaucuagucuuccacccaacuucccuguuugccauucaggugaauaucagcguaaacacccucgggugucugcagcuuacaaauauuaagcugaacgaugacaauugccagguuuucaucaaauucuugucugagcucaccagaggacccacucuguuaaacuuuacacugaaccauaucgaaaccacguggaagugucuagugagggucuuccaauuucucuggccuaaaccaguggaguaucugaauauuuacaaccuuacuauaaucgaguccauucgggaagaggacuucaccuauucaaagacaacuuugaaagcacugaccaucgaacacauaacaaaucagguguuucucuucagccagaccgcccuguacacggucuuuagugagaugaacauuaugaugcuuacuaucucugauacacccuucauccacaugcugugcccucaugcuccauccaccuuuaaguucuugaauuuuacucaaaacguuuucacagacagcauuuuugaaaaguguucgacccucgugaaacuggagacguuaauccugcagaagaauggccuaaaagaucucuucaagguaggucugaugaccaaagacaugccgucucuugagauuuuggauguguccuggaacucacuggaaagugggcgccacaaggagaauugcacaugggucgaaagcauagugguucucaaccuguccucuaauauguuaacugacagcguguucagaugucugcccccuaggaucaagguccuugauuugcauucaaacaaaauuaagagugugccaaaacagguacucaagcuggaggcacuacaggaacugaauguugccuuuaacucccucaccgaccugcccggaugcggcagcuucucuucacuuaguguguugaucaucgaucacaauagcgucucccauccuucugcugacuuuuuccaaucgugucagaaaaugcggagcauuaaggccggcgauaacccauuucagugcacaugcgagcugcgcgaguucgugaagaacauagaccaggucuccucagaaguguuagagggguggcccgacaguuacaaaugugauuauccggaaucuuaccgaggaagcccucucaaggacuuucacauguccgagcugucaugcaauaucacucuucugauuguuaccaucggugcgacaauguuggugcucgcaguaaccgucacuagccuguguauuuaucuagaucugcccugguaccucagaauggugugccaauggacgcagacaaggcggcgugcccgcaacaucccacuggaggaacuucagagaaauuugcaguuccacgcuuuuauaucuuauuccgagcaugacagugccuggguuaaaagcgaacuggugccuuacuuagagaaggaagauauccaaauuugucuccacgagaggaacuucguccccggcaaaucuaucguggagaauauuaucaacugcauagaaaaguccuauaagucaauuuuuguacugaguccaaauuucgugcagagcgaguggugucauuacgaacuuuacuuugcacaccacaaccuguuccaugaggggucgaauaaccuaauccucauucuguuggaacccaucccucagaauaguauaccaaacaaauaucacaagcugaaggcuuuaaugacccagcggacuuaccuccaauggccgaaggagaaaucuaagcgaggacuguucugggccaauauccgcgcggccuuuaacaugaaacuuacccugguuacagagaauaacgacgucaagagcuga

SEQ ID NO: 9674 - RNA, 2391 nt, Artificial Sequence
  derived and/or modified sequence opt4 from TLR6__Homo_sapiens__ABW37065
augaccaaggacaaggagcccaucgugaagagcuuccacuucgugugccugaugaucaucaucgugggcaccagaauccaguucagcgacggcaacgaguucgccguggacaagagcaagagaggccugauccacgugcccaaggaccugccccugaagaccaaggugcuggacaugagccagaacuacaucgccgagcugcaggugagcgacaugagcuuccugagcgagcugaccgugcugagacugagccacaacagaauccagcugcuggaccugagcguguucaaguucaaccaggaccuggaguaccuggaccugagccacaaccagcugcagaagaucagcugccaccccaucgugagcuucagacaccuggaccugagcuucaacgacuucaaggcccugcccaucugcaaggaguucggcaaccugagccagcugaacuuccugggccugagcgccaugaagcugcagaagcuggaccugcugcccaucgcccaccugcaccugagcuacauccugcuggaccugagaaacuacuacaucaaggagaacgagaccgagagccugcagauccugaacgccaagacccugcaccugguguuccaccccaccagccuguucgccauccaggugaacaucagcgugaacacccugggcugccugcagcugaccaacaucaagcugaacgacgacaacugccagguguucaucaaguuccugagcgagcugaccagaggccccacccugcugaacuucacccugaaccacaucgagaccaccuggaagugccuggugagaguguuccaguuccuguggcccaagcccguggaguaccugaacaucuacaaccugaccaucaucgagagcaucagagaggaggacuucaccuacagcaagaccacccugaaggcccugaccaucgagcacaucaccaaccagguguuccuguucagccagaccgcccuguacaccguguucagcgagaugaacaucaugaugcugaccaucagcgacacccccuucauccacaugcugugcccccacgcccccagcaccuucaaguuccugaacuucacccagaacguguucaccgacagcaucuucgagaagugcagcacccuggugaagcuggagacccugauccugcagaagaacggccugaaggaccuguucaaggugggccugaugaccaaggacaugcccagccuggagauccuggacgugagcuggaacagccuggagagcggcagacacaaggagaacugcaccuggguggagagcaucguggugcugaaccugagcagcaacaugcugaccgacagcguguucagaugccugccccccagaaucaaggugcuggaccugcacagcaacaagaucaagagcgugcccaagcaggugcugaagcuggaggcccugcaggagcugaacguggccuucaacagccugaccgaccugcccggcugcggcagcuucagcagccugagcgugcugaucaucgaccacaacagcgugagccaccccagcgccgacuucuuccagagcugccagaagaugagaagcaucaaggccggcgacaaccccuuccagugcaccugcgagcugagagaguucgugaagaacaucgaccaggugagcagcgaggugcuggagggcuggcccgacagcuacaagugcgacuaccccgagagcuacagaggcagcccccugaaggacuuccacaugagcgagcugagcugcaacaucacccugcugaucgugaccaucggcgccaccaugcuggugcuggccgugaccgugaccagccugugcaucuaccuggaccugcccugguaccugagaauggugugccaguggacccagaccagaagaagagccagaaacaucccccuggaggagcugcagagaaaccugcaguuccacgccuucaucagcuacagcgagcacgacagcgccugggugaagagcgagcuggugcccuaccuggagaaggaggacauccagaucugccugcacgagagaaacuucgugcccggcaagagcaucguggagaacaucaucaacugcaucgagaagagcuacaagagcaucuucgugcugagccccaacuucgugcagagcgaguggugccacuacgagcuguacuucgcccaccacaaccuguuccacgagggcagcaacaaccugauccugauccugcuggagcccaucccccagaacagcauccccaacaaguaccacaagcugaaggcccugaugacccagagaaccuaccugcaguggcccaaggagaagagcaagagaggccuguucugggccaacaucagagccgccuucaacaugaagcugacccuggugaccgagaacaacgacgugaagagcuga

SEQ ID NO: 9675 - RNA, 2391 nt, Artificial Sequence
  derived and/or modified sequence opt5 from TLR6__Homo_sapiens__ABW37065
augaccaaggacaaagagcccaucgugaaguccuuccacuuugugugccugaugauuaucauuguuggcacaagaauccaguucuccgaugggaacgaauuugccguggacaaaucuaagcggggacucauucaugugccuaaagaucugccgcuuaagacgaagguccuggacaugagccaaaauuacaucgcugagcuccagguguccgauaugucuuuccugagcgaacuuaccguucugcgccucucccacaacagaauccagcugcuggaccucucuguguuuaaauucaaucaggaucuggaguaucuugaccugagccauaaccaacuccagaagauuuccugucaccccaucgucagcuuucggcaucuggaucuuucuuucaaugacuuuaaagcccugccuauuugcaaggaguucggcaaccucucccagcugaauuuucuggggcucagcgcgaugaaacugcagaagcucgaucugcuccccaucgcucaucugcaccuuucuuacauucugcucgaccugcgcaacuauuacaucaaggagaaugagacagaaucccugcaaauucucaacgccaaaacccugcaccuuguguuccacccuacaagccuguuugccauccagguuaauaucucugugaacacccucggaugucugcagcuuacaaauauuaagcugaacgaugacaauugccaggucuucaucaaauuccucuccgagcugaccagaggccccacgcugcucaacuuuacccugaaccauauugaaacaaccuggaagugucuugugcggguguuccaauuucuguggccuaaaccggucgaguaucucaauaucuacaaccugacaauuaucgagagcauccgcgaagaggacuucaccuauuccaagacgacacugaaagcucuuaccauugaacacaucacaaaucagguuuuucucuucucucagaccgcccuguacaccguguuuagcgagaugaacauuaugaugcugacaaucuccgauacgcccuucauucacaugcucugcccucaugcucccagcaccuuuaaguuccugaauuuuacacaaaacguguucaccgacucuaucuuugaaaaguguuccacacuugucaaacuggagacccucauccugcagaagaaugggcugaaagaucuuuucaaggugggacucaugacgaaagacaugccuagccuggagauucuggauguuucuuggaacagccucgaauccggcagacacaaggagaauugcacauggguggaaucuaucgucgugcugaaccuuagcuccaauaugcugaccgacagcguuuuccggugucuucccccgcgcauuaaggugcuggaucugcauucuaacaaaaucaaguccgucccuaaacaggugcuuaagcucgaggcccugcaggaacugaaugucgcguuuaacagccucaccgaccugcccggcugcgggucuuucuccagccuuuccgugcugauuaucgaucacaauucuguuagccauccuuccgccgacuuuuuccaaucuugucagaaaaugagaagcauuaaggcuggagauaaccccuuucagugcacaugcgagcuccgggaguucgugaagaacaucgaccaggucuccagcgaagugcuggagggcuggcccgacucuuacaaaugugauuauccugaauccuaccgcgggagcccgcugaaggacuuucacaugucugagcuuuccugcaauaucacccuccugauuguuacaaucggagccacgaugcuggugcucgcugucaccgugacaagccuguguauuuaucuugaucugcccugguaccucagaauggugugccaauggacccagacacggcgcagagcccggaacaucccucuggaagaacugcagagaaaucuucaguuccacgcguuuauuucuuauagcgagcaugacuccgccuggguuaaaagcgaacugguccccuaccucgagaaggaagauauccaaaucugucugcacgagcgcaacuucgugccuggcaaaucuauuguggagaauaucauuaacugcaucgaaaaguccuauaagagcauuuuuguccucucccccaauuucgugcagucugaguggugucauuacgaacuguacuuugcucaccacaaccuuuuccaugaggggagcaauaaccugauccucauccugcuggaaccgauuccucagaauagcauccccaacaaauaucacaaacuuaaggcccugaugacccagcggacguaccuccaauggccuaaggagaaaucuaagagaggacuguucugggcuaauauucgcgccgccuuuaacaugaaacucacccugguuacagagaauaacgacgucaagagcuga

SEQ ID NO: 9676 - protein, 796 aa, Artificial Sequence [sequence omitted]

SEQ ID NO: 9677 - RNA, 2391 nt, Artificial Sequence
  TLR6__Homo_sapiens__ABW37070
augaccaaagacaaagaaccuauuguuaaaagcuuccauuuuguuugccuuaugaucauaauaguuggaaccagaauccaguucuccgacggaaaugaauuugcaguagacaagucaaaaagaggucuuauucauguuccaaaagaccuaccgcugaaaaccaaagucuuagauacgucucagaacuacaucgcugagcuucaggucucugacaugagcuuucuaucagaguugacaguuuugagacuuucccauaacagaauccagcuacuugauuuaaguguuuucaaguucaaccaggauuuagaauauuuggauuuaucucauaaucaguugcaaaagauauccugccauccuauugugaguuucaggcauuuagaucucucauucaaugauuucaaggcccugcccaucuguaaggaauuuggcaacuuaucacaacugaauuucuugggauugagugcuaugaagcugcaaaaauuagauuugcugccaauugcucacuugcaucuaaguuauauccuucuggauuuaagaaauuauuauauaaaagaaaaugagacagaaagucuacaaauucugaaugcaaaaacccuucaccuuguuuuucacccaacuaguuuauucgcuauccaagugaacauaucaguuaauacuuuagggugcuuacaacugacuaauauuaaauugaaugaugacaacugucaaguuuucauuaaauuuuuaucagaacucaccagagguccaaccuuacugaauuuuacccucaaccacauagaaacgacuuggaaaugccuggucagagucuuucaauuucuuuggcccaaaccuguggaauaucucaauauuuacaauuuaacaauaauugaaagcauucgugaagaagauuuuacuuauucuaaaacgacauugaaagcauugacaauagaacauaucacgaaccaaguuuuucuguuuucacagacagcuuuguacaccguguuuucugagaugaacauuaugauguuaaccauuucagauacaccuuuuauacacaugcuguguccucaugcaccaagcacauucaaguuuuugaacuuuacccagaacguuuucacagauaguauuuuugaaaaauguuccacguuaguuaaauuggagacacuuaucuuacaaaagaauggauuaaaagaccuuuucaaaguaggucucaugacgaaggauaugccuucuuuggaaauacuggauguuagcuggaauucuuuggaaucugguagacauaaagaaaacugcacuuggguugagaguauagugguguuaaauuugucuucaaauaugcuuacugacucuguuuucagauguuuaccucccaggaucaagguacuugaucuucacagcaauaaaauaaagagcguuccuaaacaagucguaaaacuggaagcuuugcaagaacucaauguugcuuucaauucuuuaacugaccuuccuggauguggcagcuuuagcagccuuucuguauugaucauugaucacaauucaguuucccacccaucggcugauuucuuccagagcugccagaagaugaggucaauaaaagcaggggacaauccauuccaauguaccugugagcuaagagaauuugucaaaaauauagaccaaguaucaagugaaguguuagagggcuggccugauucuuauaagugugacuacccagaaaguuauagaggaagcccacuaaaggacuuucacaugucugaauuauccugcaacauaacucugcugaucgucaccaucggugccaccaugcugguguuggcugugacugugaccucccucugcaucuacuuggaucugcccugguaucucaggauggugugccaguggacccagacucggcgcagggccaggaacauacccuuagaagaacuccaaagaaaccuccaguuucaugcuuuuauuucauauagugaacaugauucugccugggugaaaagugaauugguaccuuaccuagaaaaagaagauauacagauuugucuucaugagagaaacuuugucccuggcaagagcauuguggaaaauaucaucaacugcauugagaagaguuacaaguccaucuuuguuuugucucccaacuuuguccagagugaguggugccauuacgaacucuauuuugcccaucacaaucucuuucaugaaggaucuaauaacuuaauccucaucuuacuggaacccauuccacagaacagcauucccaacaaguaccacaagcugaaggcucucaugacgcagcggacuuauuugcaguggcccaaggagaaaagcaaacgugggcucuuuugggcuaacauuagagccgcuuuuaauaugaaauuaacacuagucacugaaaacaaugaugugaaaucuuaa

SEQ ID NO: 9678 - RNA, 2391 nt, Artificial Sequence
  derived and/or modified sequence opt1 from TLR6__Homo_sapiens__ABW37070
augaccaaggacaaggagcccaucgucaagagcuuccacuucgugugccugaugaucaucaucgugggcacccgcauccaguucagcgacgggaacgaguucgccguggacaagagcaagcggggccucauccacgucccgaaggaccugccccugaagacgaaggugcucgacaccucccagaacuacaucgccgagcuccaggugagcgacauguccuuccugagcgagcugaccguccugcgccugucccacaaccggauccagcuccuggaccugagcguguucaaguucaaccaggaccucgaguaccuggaccugucccacaaccagcuccagaagaucagcugccaccccaucguguccuuccgccaccuggaccugagcuucaacgacuucaaggcgcuccccaucugcaaggaguucgggaaccugucccagcugaacuuccucggccugagcgccaugaagcugcagaagcucgaccugcugccgaucgcccaccuccaccuguccuacauccugcucgaccugcggaacuacuacaucaaggagaacgagaccgagagccugcagauccucaacgccaagacgcugcaccuggucuuccaccccaccucccucuucgccauccaggugaacaucagcgugaacacccuggggugccugcagcucaccaacaucaagcugaacgacgacaacugccaggucuucaucaaguuccuguccgagcucacgcgcggccccacccugcugaacuucacccucaaccacaucgagaccacguggaagugccuggugcggguguuccaguuccuguggcccaagccggucgaguaccucaacaucuacaaccugaccaucaucgagagcauccgcgaggaggacuucaccuacagcaagaccacgcugaaggcgcugaccaucgagcacaucaccaaccagguguuccucuucucccagaccgcccuguacacgguguucagcgagaugaacaucaugaugcugaccaucuccgacacccccuucauccacaugcucugcccccacgcccccagcaccuucaaguuccugaacuucacgcagaacgucuucaccgacuccaucuucgagaagugcagcacccuggugaagcucgagacccugauccugcagaagaacggccucaaggaccuguucaagguggggcugaugacgaaggacaugccgucccucgagauccuggacgucagcuggaacucccuggagagcggccggcacaaggagaacugcaccuggguggaguccaucgugguccucaaccugagcuccaacaugcugaccgacagcguguuccgcugccucccgccccggaucaagguccuggaccugcacuccaacaagaucaagagcgugcccaagcaggucgugaagcucgaggcccugcaggagcugaacguggcguucaacucccucaccgaccugcccgggugcggcagcuucuccagccugagcgugcucaucaucgaccacaacuccgucagccaccccuccgccgacuucuuccagagcugccagaagaugcgcuccaucaaggccggggacaaccccuuccagugcacgugcgagcugcgggaguucgugaagaacaucgaccaggugagcuccgagguccuggagggcuggcccgacagcuacaagugcgacuacccggaguccuaccgcggcagcccccucaaggacuuccacauguccgagcugagcugcaacaucacccugcucaucgugaccaucggggccaccaugcuggugcuggccgucacggugaccucccucugcaucuaccuggaccugcccugguaccuccggauggugugccaguggacccagacccgccggcgcgcgcggaacaucccccuggaggagcugcagcgcaaccuccaguuccacgccuucaucagcuacuccgagcacgacagcgccugggucaaguccgagcuggugccguaccuggagaaggaggacauccagaucugccuccacgagcggaacuucgugcccggcaagagcaucgucgagaacaucaucaacugcaucgagaaguccuacaagagcaucuucgugcugagccccaacuucgugcaguccgaguggugccacuacgagcuguacuucgcccaccacaaccucuuccacgaggggagcaacaaccugauccugauccuccuggagcccaucccgcagaacuccauccccaacaaguaccacaagcugaaggcccucaugacccagcgcacguaccugcaguggcccaaggagaaguccaagcgcggccuguucugggcgaacauccgggccgccuucaacaugaagcucacccuggucaccgagaacaacgacgugaaguccuga

SEQ ID NO: 9679 - RNA, 2391 nt, Artificial Sequence
  derived and/or modified sequence opt2 from TLR6__Homo_sapiens__ABW37070
augaccaaggacaaggagcccaucgucaaguccuuccacuucgucugccucaugaucaucaucgucggcacccgcauccaguucuccgacggcaacgaguucgccgucgacaaguccaagcgcggccucauccacguccccaaggaccucccccucaagaccaagguccucgacaccucccagaacuacaucgccgagcuccaggucuccgacauguccuuccucuccgagcucaccguccuccgccucucccacaaccgcauccagcuccucgaccucuccgucuucaaguucaaccaggaccucgaguaccucgaccucucccacaaccagcuccagaagaucuccugccaccccaucgucuccuuccgccaccucgaccucuccuucaacgacuucaaggcccuccccaucugcaaggaguucggcaaccucucccagcucaacuuccucggccucuccgccaugaagcuccagaagcucgaccuccuccccaucgcccaccuccaccucuccuacauccuccucgaccuccgcaacuacuacaucaaggagaacgagaccgagucccuccagauccucaacgccaagacccuccaccucgucuuccaccccaccucccucuucgccauccaggucaacaucuccgucaacacccucggcugccuccagcucaccaacaucaagcucaacgacgacaacugccaggucuucaucaaguuccucuccgagcucacccgcggccccacccuccucaacuucacccucaaccacaucgagaccaccuggaagugccucguccgcgucuuccaguuccucuggcccaagcccgucgaguaccucaacaucuacaaccucaccaucaucgaguccauccgcgaggaggacuucaccuacuccaagaccacccucaaggcccucaccaucgagcacaucaccaaccaggucuuccucuucucccagaccgcccucuacaccgucuucuccgagaugaacaucaugaugcucaccaucuccgacacccccuucauccacaugcucugcccccacgcccccuccaccuucaaguuccucaacuucacccagaacgucuucaccgacuccaucuucgagaagugcuccacccucgucaagcucgagacccucauccuccagaagaacggccucaaggaccucuucaaggucggccucaugaccaaggacaugcccucccucgagauccucgacgucuccuggaacucccucgaguccggccgccacaaggagaacugcaccugggucgaguccaucgucguccucaaccucuccuccaacaugcucaccgacuccgucuuccgcugccuccccccccgcaucaagguccucgaccuccacuccaacaagaucaaguccguccccaagcaggucgucaagcucgaggcccuccaggagcucaacgucgccuucaacucccucaccgaccuccccggcugcggcuccuucuccucccucuccguccucaucaucgaccacaacuccgucucccaccccuccgccgacuucuuccaguccugccagaagaugcgcuccaucaaggccggcgacaaccccuuccagugcaccugcgagcuccgcgaguucgucaagaacaucgaccaggucuccuccgagguccucgagggcuggcccgacuccuacaagugcgacuaccccgaguccuaccgcggcuccccccucaaggacuuccacauguccgagcucuccugcaacaucacccuccucaucgucaccaucggcgccaccaugcucguccucgccgucaccgucaccucccucugcaucuaccucgaccuccccugguaccuccgcauggucugccaguggacccagacccgccgccgcgcccgcaacaucccccucgaggagcuccagcgcaaccuccaguuccacgccuucaucuccuacuccgagcacgacuccgccugggucaaguccgagcucguccccuaccucgagaaggaggacauccagaucugccuccacgagcgcaacuucguccccggcaaguccaucgucgagaacaucaucaacugcaucgagaaguccuacaaguccaucuucguccucucccccaacuucguccaguccgaguggugccacuacgagcucuacuucgcccaccacaaccucuuccacgagggcuccaacaaccucauccucauccuccucgagcccaucccccagaacuccauccccaacaaguaccacaagcucaaggcccucaugacccagcgcaccuaccuccaguggcccaaggagaaguccaagcgcggccucuucugggccaacauccgcgccgccuucaacaugaagcucacccucgucaccgagaacaacgacgucaaguccuga

SEQ ID NO: 9680 - RNA, 2391 nt, Artificial Sequence
  derived and/or modified sequence opt3 from TLR6__Homo_sapiens__ABW37070
augaccaaggacaaagagcccaucgugaaguccuuccacuuugugugccugaugauuauaaucguuggcacaaggauucaguucuccgaugggaacgaauuugccguggacaaaucuaagagaggacucauccauguaccuaaagaucuuccacugaagacuaagguguuggacacgucacaaaauuacauugcugaguuacaggucagugauaugagcuuccuguccgaacuaaccgugcuccggcugucucacaaccgcauccagcuucuggacuugucgguuuuuaaauucaaucaggaucucgaguaucuggaccugucacauaaccaacuccagaagauaagcugucacccgaucgugaguuuucgacauuuagaucuguccuucaaugacuuuaaagcacuucccauuugcaaggaguucgguaacuugucucagcugaauuuucuaggccucagcgccaugaaacugcagaaacuugaucuguugccuaucgcgcaccuccaccuguccuacauuuuacuggaccuccguaacuauuacaucaaggagaaugagacagaaucacuucaaauacugaacgcuaagacuuugcaucuagucuuccacccaaccagucuguuugccauucaggugaauaucagcguaaacacacucgggugucugcagcuuaccaauauuaagcugaacgaugacaauugccagguuuucaucaaauucuugucugagcucacuagaggacccacacuguuaaacuuuacccugaaccauaucgaaacgacuuggaagugucuagugagggucuuccaauuucucuggccuaaaccaguggaguaucugaauauuuacaaccuuaccauaaucgaguccauucgggaagaggacuucacauauucaaagacuaccuugaaagcacugacaaucgaacacauaaccaaucagguguuucucuucagccagacggcccuguacacugucuuuagugagaugaacauuaugaugcuuacaaucucugauacccccuucauccacaugcugugcccucaugcuccauccacuuuuaaguucuugaauuuuacacaaaacguuuucaccgacagcauuuuugaaaaguguucgacgcucgugaaacuggagaccuuaauccugcagaagaauggccuaaaagaucucuucaagguaggucugaugacaaaagacaugccgucucuugagauuuuggauguguccuggaacucacuggaaagugggcgccacaaggagaauugcacuugggucgaaagcauagugguucucaaccuguccucuaauauguuaaccgacagcguguucagaugucugcccccuaggaucaagguccuugauuugcauucaaacaaaauuaagagugugccaaaacagguaguuaagcucgaggcacugcaggaacuaaauguggccuuuaacucccugacagaccuccccggaugcggcagcuucucuucacugaguguccuuaucaucgaucacaauagcgugucccauccuucugcugacuuuuuccaaucgugucagaaaaugcggagcauuaaggccggcgauaacccauuucagugcacuugcgaguugcgcgaguucgucaagaacauagaccagguguccucagaaguucuggagggguggcccgacaguuacaaaugugauuauccggaaucuuaccgaggaagcccuuuaaaggacuuucacauguccgagcucucaugcaauaucacccugcuuauugugacaaucggugcgaccaugcugguauuggcagucacugugacgagccucuguauuuaucuggaucuacccugguaccugagaaugguuugccaauggacacagaccaggcggcgugcccgcaacaucccacucgaagaacugcagagaaaucuucaguuccacgcuuuuauaucuuauuccgagcaugacagugccugggugaaaagcgaauuggucccuuaccuggagaaggaagauauccaaauuuguuuacacgagaggaacuucgugcccggcaaaucuaucguagagaauauuaucaacugcauagaaaaguccuauaagucaauuuuugugcucaguccaaauuucguucagagcgaguggugucauuacgaacuguacuuugcacaccacaaccuuuuccaugaggggucgaauaaccugauccuaauucuccuggaacccaucccucagaauagcauaccaaacaaauaucacaaguugaaagcucugaugacucagcggaccuacuuacaauggccgaaggagaaaucuaagcgaggacucuucugggccaauauccgcgcggccuuuaacaugaaacugacacuugucaccgagaauaacgacgucaagagcuga

SEQ ID NO: 9681 - RNA, 2391 nt, Artificial Sequence
  derived and/or modified sequence opt4 from TLR6__Homo_sapiens__ABW37070
augaccaaggacaaggagcccaucgugaagagcuuccacuucgugugccugaugaucaucaucgugggcaccagaauccaguucagcgacggcaacgaguucgccguggacaagagcaagagaggccugauccacgugcccaaggaccugccccugaagaccaaggugcuggacaccagccagaacuacaucgccgagcugcaggugagcgacaugagcuuccugagcgagcugaccgugcugagacugagccacaacagaauccagcugcuggaccugagcguguucaaguucaaccaggaccuggaguaccuggaccugagccacaaccagcugcagaagaucagcugccaccccaucgugagcuucagacaccuggaccugagcuucaacgacuucaaggcccugcccaucugcaaggaguucggcaaccugagccagcugaacuuccugggccugagcgccaugaagcugcagaagcuggaccugcugcccaucgcccaccugcaccugagcuacauccugcuggaccugagaaacuacuacaucaaggagaacgagaccgagagccugcagauccugaacgccaagacccugcaccugguguuccaccccaccagccuguucgccauccaggugaacaucagcgugaacacccugggcugccugcagcugaccaacaucaagcugaacgacgacaacugccagguguucaucaaguuccugagcgagcugaccagaggccccacccugcugaacuucacccugaaccacaucgagaccaccuggaagugccuggugagaguguuccaguuccuguggcccaagcccguggaguaccugaacaucuacaaccugaccaucaucgagagcaucagagaggaggacuucaccuacagcaagaccacccugaaggcccugaccaucgagcacaucaccaaccagguguuccuguucagccagaccgcccuguacaccguguucagcgagaugaacaucaugaugcugaccaucagcgacacccccuucauccacaugcugugcccccacgcccccagcaccuucaaguuccugaacuucacccagaacguguucaccgacagcaucuucgagaagugcagcacccuggugaagcuggagacccugauccugcagaagaacggccugaaggaccuguucaaggugggccugaugaccaaggacaugcccagccuggagauccuggacgugagcuggaacagccuggagagcggcagacacaaggagaacugcaccuggguggagagcaucguggugcugaaccugagcagcaacaugcugaccgacagcguguucagaugccugccccccagaaucaaggugcuggaccugcacagcaacaagaucaagagcgugcccaagcagguggugaagcuggaggcccugcaggagcugaacguggccuucaacagccugaccgaccugcccggcugcggcagcuucagcagccugagcgugcugaucaucgaccacaacagcgugagccaccccagcgccgacuucuuccagagcugccagaagaugagaagcaucaaggccggcgacaaccccuuccagugcaccugcgagcugagagaguucgugaagaacaucgaccaggugagcagcgaggugcuggagggcuggcccgacagcuacaagugcgacuaccccgagagcuacagaggcagcccccugaaggacuuccacaugagcgagcugagcugcaacaucacccugcugaucgugaccaucggcgccaccaugcuggugcuggccgugaccgugaccagccugugcaucuaccuggaccugcccugguaccugagaauggugugccaguggacccagaccagaagaagagccagaaacaucccccuggaggagcugcagagaaaccugcaguuccacgccuucaucagcuacagcgagcacgacagcgccugggugaagagcgagcuggugcccuaccuggagaaggaggacauccagaucugccugcacgagagaaacuucgugcccggcaagagcaucguggagaacaucaucaacugcaucgagaagagcuacaagagcaucuucgugcugagccccaacuucgugcagagcgaguggugccacuacgagcuguacuucgcccaccacaaccuguuccacgagggcagcaacaaccugauccugauccugcuggagcccaucccccagaacagcauccccaacaaguaccacaagcugaaggcccugaugacccagagaaccuaccugcaguggcccaaggagaagagcaagagaggccuguucugggccaacaucagagccgccuucaacaugaagcugacccuggugaccgagaacaacgacgugaagagcuga

SEQ ID NO: 9682 - RNA, 2391 nt, Artificial Sequence
  derived and/or modified sequence opt5 from TLR6__Homo_sapiens__ABW37070
augaccaaggacaaagagcccaucgugaaguccuuccacuuugucugccugaugauuaucauuguuggcacaagaauccaguucuccgaugggaacgaauuugccguggacaaaucuaagcggggacucauucaugugccuaaagaucugccgcuuaagacgaagguccuggacaccagccaaaauuacaucgcugagcuccagguguccgauaugucuuuccugagcgaacuuacaguucugcgccucucccacaacagaauccagcugcuggaccucucuguguuuaaauucaaucaggaucuggaguaucuugaccugagccauaaccaacuccagaagauuuccugucaccccaucgucagcuuucggcaucuggaucuuucuuucaaugacuuuaaagcccugccuauuugcaaggaguucggcaaccucucccagcugaauuuucuggggcucagcgcgaugaaacugcagaagcucgaucugcuccccaucgcucaucugcaccuuucuuacauucugcucgaccugcgcaacuauuacaucaaggagaaugagaccgaaucccugcaaauucucaacgccaaaacacugcaccuuguguuccacccuaccagccuguuugccauccagguuaauaucucugugaacacacucggaugucugcagcuuaccaauauuaagcugaacgaugacaauugccaggucuucaucaaauuccucuccgagcugacgagaggccccacccugcucaacuuuacacugaaccauauugaaaccacauggaagugucuugugcggguguuccaauuucuguggccuaaaccggucgaguaucucaauaucuacaaccugaccauuaucgagagcauccgcgaagaggacuucacguauuccaagacaacccugaaagcucuuacaauugaacacaucaccaaucagguuuuucucuucucucagaccgcccuguacacaguguuuagcgagaugaacauuaugaugcugacgaucuccgauacccccuucauucacaugcucugcccucaugcucccagcacauuuaaguuccugaauuuuacccaaaacguguucacagacucuaucuuugaaaaguguuccacccuugucaaacuggagacgcucauccugcagaagaaugggcugaaagaucuuuucaaggugggacucaugacaaaagacaugccuagccuggagauucuggauguuucuuggaacagccucgaauccggcagacacaaggagaauugcaccuggguggaaucuaucgucgugcugaaccuuagcuccaauaugcugaccgacagcguuuuccggugucuucccccgcgcauuaaggugcuggaucugcauucuaacaaaaucaaguccgucccuaaacagguggucaaacuugaggcccuccaggaacugaauguggcguuuaacagccugacagaccuccccggcugcgggucuuucuccagccuguccguucuuauuaucgaucacaauucugugagccauccuuccgccgacuuuuuccaaucuugucagaagaugagaagcauuaaggcuggagauaaccccuuucaguguaccugcgagcugcgggaguucgucaagaacaucgaccagguguccagcgaaguucucgagggcuggcccgacucuuacaaaugcgauuauccugaauccuaccgcgggagcccgcugaaggacuuucacaugucugagcuguccugcaauaucacacuucucauugugacgaucggagccaccaugcugguccuggcugugacagugaccagccucuguauuuaucuggaucuucccugguaccugagaaugguuugccaauggacacagacccggcgcagagcccggaacaucccucucgaagaacugcagagaaaucugcaguuccacgcguuuauuucuuauagcgagcaugacuccgccugggucaaaagcgaacuugugcccuaccuggagaaggaagauauccaaaucugucuccacgagcgcaacuucgugccuggcaaaucuauugucgagaauaucauuaacugcaucgaaaaguccuauaagagcauuuuugugcugucccccaauuucguucagucugaguggugucauuacgaacucuacuuugcucaccacaaccuguuccaugaggggagcaauaaccuuauccugauccuccuggaaccgauuccucagaauagcauccccaacaaauaucacaagcugaaagcccuuaugacgcagcggaccuaccugcaauggccuaaggagaaaucuaagagaggacucuucugggcuaauauucgcgccgccuuuaacaugaaacugacacucgugaccgagaauaacgacgucaagagcuga

SEQ ID NO: 9683 - protein, 796 aa, Artificial Sequence [sequence omitted]

SEQ ID NO: 9684 - RNA, 2391 nt, Artificial Sequence
  TLR6__Homo_sapiens__ABW37072
augaccaaagacaaagaaccuauuguuaaaagcuuccauuuuguuugccuuaugaucauaauaguuggaaccagaauccaguucuccgacggaaaugaauuugcaguagacaagucaaaaagaggucuuauucauguuccaaaagaccuaccgcugaaaaccaaagucuuagauaugucucagaacuacaucgcugagcuucaggucucugacaugagcuuucuaucagaguugacaguuuugagacuuucccauaacagaauccagcuacuugauuuaaguguuuucaaguucaaccaggauuuagaauauuuggauuuaucucauaaucaguugcaaaagauauccugccauccuacugugaguuucaggcauuuagaucucucauucaaugauuucaaggcccugcccaucuguaaggaauuuggcaacuuaucacaacugaauuucuugggauugagugcuaugaagcugcaaaaauuagauuugcugccaauugcucacuugcaucuaaguuauauccuucuggauuuaagaaauuauuauauaaaagaaaaugagacagaaagucuacaaauucugaaugcaaaaacccuucaccuuguuuuucacccaacuaguuuauucgcuauccaagugaacauaucaguuaauacuuuagggugcuuacaacugacuaauauuaaauugaaugaugacaacugucaaguuuucauuaaauuuuuaucagaacucaccagagguccaaccuuacugaauuuuacccucaaccacauagaaacgacuuggaaaugccuggucagagucuuucaauuucuuuggcccaaaccuguggaauaucucaauauuuacaauuuaacaauaauugaaagcauucgugaagaagauuuuacuuauucuaaaacgacauugaaagcauugacaauagaacauaucacgaaccaaguuuuucuguuuucacagacagcuuuguacaccguguuuucugagaugaacauuaugauguuaaccauuucagauacaccuuuuauacacaugcuguguccucaugcaccaagcacauucaaguuuuugaacuuuacgcagaacguuuucacagauaguauuuuugaaaaauguuccacguuaguuaaauuggagacacuuaucuuacaaaagaauggauuaaaagaccuuuucaaaguaggucucaugacgaaggauaugccuucuuuggaaauacuggauguuagcuggaauucuuuggaaucugguagacauaaggaaaacugcacuuggguugagaguauagugguguuaaauuugucuucaaauaugcuuacugacucuguuuucagauguuuaccucccaggaucaagguacuugaucuucacagcaauaaaauaaagagcauuccuaaacaagucguaaaacuggaagcuuugcaagaacucaauguugcuuucaauucuuuaacugaccuuccuggauguggcagcuuuagcagccuuucuguauugaucauugaucacaauucaguuucccacccaucggcugauuucuuccagagcugccagaagaugaggucaauaaaagcaggggacaauccauuccaauguaccugugagcuaagagaauuugucaaaaauauagaccaaguaucaagugaaguguuagagggcuggccugauucuuauaagugugacuacccagaaaguuauagaggaagcccacuaaaggacuuucacaugucugaauuauccugcaacauaacucugcugaucgucaccaucggugccaccaugcugguguuggcugugacugugaccucccucugcaucuacuuggaucugcccugguaucucaggauggugugccaguggacccagacucggcgcagggccaggaacauacccuuagaagaacuccaaagaaaccuccaguuucaugcuuuuauuucauauagugaacaugauucugccugggugaaaagugaauugguaccuuaccuagaaaaagaagauauacagauuugucuucaugagagaaacuuugucccuggcaagagcauuguggaaaauaucaucaacugcauugagaagaguuacaaguccaucuuuguuuugucucccaacuuuguccagagugaguggugccauuacgaacucuauuuugcccaucacaaucucuuucaugaaggaucuaauaacuuaauccucaucuuacuggaacccauuccacagaacagcauucccaacaaguaccacaagcugaaggcucucaugacgcagcggacuuauuugcaguggcccaaggagaaaagcaaacgugggcucuuuugggcuaacauuagagccgcuuuuaauaugaaauuaacacuagucacugaaaacaaugaugugaaaucuuaa

SEQ ID NO: 9685 - RNA, 2391 nt, Artificial Sequence
  derived and/or modified sequence opt1 from TLR6__Homo_sapiens__ABW37072
augaccaaggacaaggagcccaucgucaagagcuuccacuucgugugccugaugaucaucaucgugggcacccgcauccaguucuccgacgggaacgaguucgccguggacaagagcaagcggggccucauccacgucccgaaggaccugccccugaagacgaaggugcucgacaugucccagaacuacaucgccgagcuccaggugagcgacauguccuuccugagcgagcugaccguccugcgccugucccacaaccggauccagcuccuggaccugagcguguucaaguucaaccaggaccucgaguaccuggaccugucccacaaccagcuccagaagaucagcugccaccccaccguguccuuccgccaccuggaccugagcuucaacgacuucaaggcgcuccccaucugcaaggaguucgggaaccugucccagcugaacuuccucggccugagcgccaugaagcugcagaagcucgaccugcugccgaucgcccaccuccaccuguccuacauccugcucgaccugcggaacuacuacaucaaggagaacgagaccgagagccugcagauccucaacgccaagacgcugcaccuggucuuccaccccaccucccucuucgccauccaggugaacaucagcgugaacacccuggggugccugcagcucaccaacaucaagcugaacgacgacaacugccaggucuucaucaaguuccuguccgagcucacgcgcggccccacccugcugaacuucacccucaaccacaucgagaccacguggaagugccuggugcggguguuccaguuccuguggcccaagccggucgaguaccucaacaucuacaaccugaccaucaucgagagcauccgcgaggaggacuucaccuacagcaagaccacgcugaaggcgcugaccaucgagcacaucaccaaccagguguuccucuucucccagaccgcccuguacacgguguucagcgagaugaacaucaugaugcugaccaucuccgacacccccuucauccacaugcucugcccccacgcccccagcaccuucaaguuccugaacuucacgcagaacgucuucaccgacuccaucuucgagaagugcagcacccuggugaagcucgagacccugauccugcagaagaacggccucaaggaccuguucaagguggggcugaugacgaaggacaugccgucccucgagauccuggacgucagcuggaacucccuggagagcggccggcacaaggagaacugcaccuggguggaguccaucgugguccucaaccugagcuccaacaugcugaccgacagcguguuccgcugccucccgccccggaucaagguccuggaccugcacuccaacaagaucaagagcauccccaagcaggucgugaagcucgaggcccugcaggagcugaacguggcguucaacucccucaccgaccugcccgggugcggcagcuucuccagccugagcgugcucaucaucgaccacaacuccgugagccaccccuccgccgacuucuuccagagcugccagaagaugcgcuccaucaaggccggggacaaccccuuccagugcacgugcgagcugcgggaguucgucaagaacaucgaccaggugagcuccgaggugcuggagggcuggcccgacagcuacaagugcgacuacccggaguccuaccgcggcagcccccucaaggacuuccacauguccgagcugagcugcaacaucacccugcucaucgucaccaucggggccaccaugcuggugcuggccgugacggucaccucccucugcaucuaccuggaccugcccugguaccuccggauggugugccaguggacccagacccgccggcgcgcgcggaacaucccccuggaggagcugcagcgcaaccuccaguuccacgccuucaucagcuacuccgagcacgacagcgccugggugaaguccgagcuggucccguaccuggagaaggaggacauccagaucugccuccacgagcggaacuucgugcccggcaagagcaucguggagaacaucaucaacugcaucgagaaguccuacaagagcaucuucguccugagccccaacuucgugcaguccgaguggugccacuacgagcuguacuucgcccaccacaaccucuuccacgaggggagcaacaaccugauccugauccuccuggagcccaucccgcagaacuccauccccaacaaguaccacaagcugaaggcccucaugacccagcgcacguaccugcaguggcccaaggagaaguccaagcgcggccuguucugggcgaacauccgggccgccuucaacaugaagcucacccuggugaccgagaacaacgacgucaagagcuga

SEQ ID NO: 9686 - RNA, 2391 nt, Artificial Sequence
  derived and/or modified sequence opt2 from TLR6__Homo_sapiens__ABW37072
augaccaaggacaaggagcccaucgucaaguccuuccacuucgucugccucaugaucaucaucgucggcacccgcauccaguucuccgacggcaacgaguucgccgucgacaaguccaagcgcggccucauccacguccccaaggaccucccccucaagaccaagguccucgacaugucccagaacuacaucgccgagcuccaggucuccgacauguccuuccucuccgagcucaccguccuccgccucucccacaaccgcauccagcuccucgaccucuccgucuucaaguucaaccaggaccucgaguaccucgaccucucccacaaccagcuccagaagaucuccugccaccccaccgucuccuuccgccaccucgaccucuccuucaacgacuucaaggcccuccccaucugcaaggaguucggcaaccucucccagcucaacuuccucggccucuccgccaugaagcuccagaagcucgaccuccuccccaucgcccaccuccaccucuccuacauccuccucgaccuccgcaacuacuacaucaaggagaacgagaccgagucccuccagauccucaacgccaagacccuccaccucgucuuccaccccaccucccucuucgccauccaggucaacaucuccgucaacacccucggcugccuccagcucaccaacaucaagcucaacgacgacaacugccaggucuucaucaaguuccucuccgagcucacccgcggccccacccuccucaacuucacccucaaccacaucgagaccaccuggaagugccucguccgcgucuuccaguuccucuggcccaagcccgucgaguaccucaacaucuacaaccucaccaucaucgaguccauccgcgaggaggacuucaccuacuccaagaccacccucaaggcccucaccaucgagcacaucaccaaccaggucuuccucuucucccagaccgcccucuacaccgucuucuccgagaugaacaucaugaugcucaccaucuccgacacccccuucauccacaugcucugcccccacgcccccuccaccuucaaguuccucaacuucacccagaacgucuucaccgacuccaucuucgagaagugcuccacccucgucaagcucgagacccucauccuccagaagaacggccucaaggaccucuucaaggucggccucaugaccaaggacaugcccucccucgagauccucgacgucuccuggaacucccucgaguccggccgccacaaggagaacugcaccugggucgaguccaucgucguccucaaccucuccuccaacaugcucaccgacuccgucuuccgcugccuccccccccgcaucaagguccucgaccuccacuccaacaagaucaaguccauccccaagcaggucgucaagcucgaggcccuccaggagcucaacgucgccuucaacucccucaccgaccuccccggcugcggcuccuucuccucccucuccguccucaucaucgaccacaacuccgucucccaccccuccgccgacuucuuccaguccugccagaagaugcgcuccaucaaggccggcgacaaccccuuccagugcaccugcgagcuccgcgaguucgucaagaacaucgaccaggucuccuccgagguccucgagggcuggcccgacuccuacaagugcgacuaccccgaguccuaccgcggcuccccccucaaggacuuccacauguccgagcucuccugcaacaucacccuccucaucgucaccaucggcgccaccaugcucguccucgccgucaccgucaccucccucugcaucuaccucgaccuccccugguaccuccgcauggucugccaguggacccagacccgccgccgcgcccgcaacaucccccucgaggagcuccagcgcaaccuccaguuccacgccuucaucuccuacuccgagcacgacuccgccugggucaaguccgagcucguccccuaccucgagaaggaggacauccagaucugccuccacgagcgcaacuucguccccggcaaguccaucgucgagaacaucaucaacugcaucgagaaguccuacaaguccaucuucguccucucccccaacuucguccaguccgaguggugccacuacgagcucuacuucgcccaccacaaccucuuccacgagggcuccaacaaccucauccucauccuccucgagcccaucccccagaacuccauccccaacaaguaccacaagcucaaggcccucaugacccagcgcaccuaccuccaguggcccaaggagaaguccaagcgcggccucuucugggccaacauccgcgccgccuucaacaugaagcucacccucgucaccgagaacaacgacgucaaguccuga

SEQ ID NO: 9687 - RNA, 2391 nt, Artificial Sequence
  derived and/or modified sequence opt3 from TLR6__Homo_sapiens__ABW37072
augaccaaggacaaagagcccaucgugaaguccuuccacuuugucugccugaugauuauaaucguuggcacaaggauucaguucuccgaugggaacgaauuugccguggacaaaucuaagagaggacucauccauguaccuaaagaucuuccacugaagacuaagguguuggacaugucacaaaauuacauugcugaguuacaggucagugauaugagcuuccuguccgaacuaacggugcuccggcugucucacaaccgcauccagcuucuggacuugucgguuuuuaaauucaaucaggaucucgaguaucuggaccugucacauaaccaacuccagaagauaagcugucacccgaccgugaguuuucgacauuuagaucuguccuucaaugacuuuaaagcacuucccaucugcaaggaguucgguaacuugucucagcugaauuuucuaggccucagcgccaugaaacugcagaaacuugaucuguugccuauugcgcaccuccaccuguccuacaucuuacuggaccuccguaacuauuacauuaaggagaaugagacagaaucacuucaaauccugaacgcuaagacuuugcaucuagucuuccacccaaccagucuguuugccauacaggugaauauuagcguaaacacacucgggugucugcagcuuaccaauaucaagcugaacgaugacaauugccagguuuucauuaaauucuugucugagcucacuagaggacccacacuguuaaacuuuacccugaaccauaucgaaacgacuuggaagugucuagugagggucuuccaauuucucuggccuaaaccaguggaguaucugaauaucuacaaccuuaccauuauagaguccauccgggaagaggacuucacauauucaaagacuaccuugaaagcacugacaauugaacacaucaccaaucagguguuucucuucagccagacggcccuguacacugucuuuagugagaugaacauaaugaugcuuacaauuucugauacccccuucauccacaugcugugcccucaugcuccauccacuuuuaaguucuugaauuuuacacaaaacguuuucaccgacagcaucuuugaaaaguguucgacgcucgugaaacuggagaccuuaauucugcagaagaauggccuaaaagaucucuucaagguaggucugaugacaaaagacaugccgucucuugagaucuuggauguguccuggaacucacuggaaagugggcgccacaaggagaauugcacuugggucgaaagcauugugguucucaaccuguccucuaauauguuaaccgacagcguguucagaugucugcccccuaggauaaagguccuugauuugcauucaaacaaaaucaagaguauuccaaaacaggugguaaagcucgaggcacugcaggaacuaaauguugccuuuaacucccugacagaccuccccggaugcggcagcuucucuucacugagugugcuuaucaucgaucacaauagcgucucccauccuucugcugacuuuuuccaaucgugucagaaaaugcggagcauuaaggccggcgauaacccauuucagugcacuugcgaguugcgcgaguucgugaagaacauagaccaggucuccucagaagugcuggagggguggcccgacaguuacaaaugugauuauccggaaucuuaccgaggaagcccuuuaaaggacuuucacauguccgagcucucaugcaauaucacccugcuuauuguuacaaucggugcgaccaugcugguguuggcaguaacugucacgagccucuguauuuaucuggaucuacccugguaccugagaauggugugccaauggacacagaccaggcggcgugcccgcaacaucccacucgaagaacugcagagaaaucuucaguuccacgcuuuuauaucuuauuccgagcaugacagugccuggguuaaaagcgaauuggugccuuaccuggagaaggaagauauccaaauuuguuuacacgagaggaacuucguccccggcaaaucuaucguggagaauauuaucaacugcauagaaaaguccuauaagucaauuuuuguacucaguccaaauuucgugcagagcgaguggugucauuacgaacuguacuuugcacaccacaaccuuuuccaugaggggucgaauaaccugauccuaauucuccuggaacccaucccucagaauagcauaccaaacaaauaucacaaguugaaagcucugaugacucagcggaccuacuuacaauggccgaaggagaaaucuaagcgaggacucuucugggccaauauccgcgcggccuuuaacaugaaacugacacuuguuaccgagaauaacgacgucaagagcuga

SEQ ID NO: 9688 - RNA, 2391 nt, Artificial Sequence
  derived and/or modified sequence opt4 from TLR6__Homo_sapiens__ABW37072
augaccaaggacaaggagcccaucgugaagagcuuccacuucgugugccugaugaucaucaucgugggcaccagaauccaguucagcgacggcaacgaguucgccguggacaagagcaagagaggccugauccacgugcccaaggaccugccccugaagaccaaggugcuggacaugagccagaacuacaucgccgagcugcaggugagcgacaugagcuuccugagcgagcugaccgugcugagacugagccacaacagaauccagcugcuggaccugagcguguucaaguucaaccaggaccuggaguaccuggaccugagccacaaccagcugcagaagaucagcugccaccccaccgugagcuucagacaccuggaccugagcuucaacgacuucaaggcccugcccaucugcaaggaguucggcaaccugagccagcugaacuuccugggccugagcgccaugaagcugcagaagcuggaccugcugcccaucgcccaccugcaccugagcuacauccugcuggaccugagaaacuacuacaucaaggagaacgagaccgagagccugcagauccugaacgccaagacccugcaccugguguuccaccccaccagccuguucgccauccaggugaacaucagcgugaacacccugggcugccugcagcugaccaacaucaagcugaacgacgacaacugccagguguucaucaaguuccugagcgagcugaccagaggccccacccugcugaacuucacccugaaccacaucgagaccaccuggaagugccuggugagaguguuccaguuccuguggcccaagcccguggaguaccugaacaucuacaaccugaccaucaucgagagcaucagagaggaggacuucaccuacagcaagaccacccugaaggcccugaccaucgagcacaucaccaaccagguguuccuguucagccagaccgcccuguacaccguguucagcgagaugaacaucaugaugcugaccaucagcgacacccccuucauccacaugcugugcccccacgcccccagcaccuucaaguuccugaacuucacccagaacguguucaccgacagcaucuucgagaagugcagcacccuggugaagcuggagacccugauccugcagaagaacggccugaaggaccuguucaaggugggccugaugaccaaggacaugcccagccuggagauccuggacgugagcuggaacagccuggagagcggcagacacaaggagaacugcaccuggguggagagcaucguggugcugaaccugagcagcaacaugcugaccgacagcguguucagaugccugccccccagaaucaaggugcuggaccugcacagcaacaagaucaagagcauccccaagcagguggugaagcuggaggcccugcaggagcugaacguggccuucaacagccugaccgaccugcccggcugcggcagcuucagcagccugagcgugcugaucaucgaccacaacagcgugagccaccccagcgccgacuucuuccagagcugccagaagaugagaagcaucaaggccggcgacaaccccuuccagugcaccugcgagcugagagaguucgugaagaacaucgaccaggugagcagcgaggugcuggagggcuggcccgacagcuacaagugcgacuaccccgagagcuacagaggcagcccccugaaggacuuccacaugagcgagcugagcugcaacaucacccugcugaucgugaccaucggcgccaccaugcuggugcuggccgugaccgugaccagccugugcaucuaccuggaccugcccugguaccugagaauggugugccaguggacccagaccagaagaagagccagaaacaucccccuggaggagcugcagagaaaccugcaguuccacgccuucaucagcuacagcgagcacgacagcgccugggugaagagcgagcuggugcccuaccuggagaaggaggacauccagaucugccugcacgagagaaacuucgugcccggcaagagcaucguggagaacaucaucaacugcaucgagaagagcuacaagagcaucuucgugcugagccccaacuucgugcagagcgaguggugccacuacgagcuguacuucgcccaccacaaccuguuccacgagggcagcaacaaccugauccugauccugcuggagcccaucccccagaacagcauccccaacaaguaccacaagcugaaggcccugaugacccagagaaccuaccugcaguggcccaaggagaagagcaagagaggccuguucugggccaacaucagagccgccuucaacaugaagcugacccuggugaccgagaacaacgacgugaagagcuga

SEQ ID NO: 9689 - RNA, 2391 nt, Artificial Sequence
  derived and/or modified sequence opt5 from TLR6__Homo_sapiens__ABW37072
augaccaaggacaaagagcccaucgugaaguccuuccacuuugugugccugaugauuaucauuguuggcacaagaauccaguucuccgaugggaacgaauuugccguggacaaaucuaagcggggacucauucaugugccuaaagaucugccgcuuaagacgaagguccuggacaugagccaaaauuacaucgcugagcuccagguguccgauaugucuuuccugagcgaacuuaccguucugcgccucucccacaacagaauccagcugcuggaccucucuguguuuaaauucaaucaggaucuggaguaucuugaccugagccauaaccaacuccagaagauuuccugucaccccacagucagcuuucggcaucuggaucuuucuuucaaugacuuuaaagcccugccuaucugcaaggaguucggcaaccucucccagcugaauuuucuggggcucagcgcgaugaaacugcagaagcucgaucugcuccccauugcucaucugcaccuuucuuacauccugcucgaccugcgcaacuauuacauuaaggagaaugagaccgaaucccugcaaauccucaacgccaaaacacugcaccuuguguuccacccuaccagccuguuugccauucagguuaauaucucugugaacacacucggaugucugcagcuuaccaauaucaagcugaacgaugacaauugccaggucuucauuaaauuccucuccgagcugacgagaggccccacccugcucaacuuuacacugaaccauaucgaaaccacauggaagugucuugugcggguguuccaauuucuguggccuaaaccggucgaguaucucaauauuuacaaccugaccaucauugagagcauccgcgaagaggacuucacguauuccaagacaacccugaaagcucuuacaaucgaacacauuaccaaucagguuuuucucuucucucagaccgcccuguacacaguguuuagcgagaugaacaucaugaugcugacgauuuccgauacccccuucauccacaugcucugcccucaugcucccagcacauuuaaguuccugaauuuuacccaaaacguguucacagacucuauuuuugaaaaguguuccacccuugucaaacuggagacgcucauccugcagaagaaugggcugaaagaucuuuucaaggugggacucaugacaaaagacaugccuagccuggagauccuggauguuucuuggaacagccucgaauccggcagacacaaggagaauugcaccuggguggaaucuauugucgugcugaaccuuagcuccaauaugcugaccgacagcguuuuccggugucuucccccgcgcaucaaggugcuggaucugcauucuaacaaaauuaaguccaucccuaaacaggucgugaaacuugaggcccuccaggaacugaaugucgcguuuaacagccugacagaccuccccggcugcgggucuuucuccagccuguccgugcuuauuaucgaucacaauucuguuagccauccuuccgccgacuuuuuccaaucuugucagaagaugagaagcauuaaggcuggagauaaccccuuucaguguaccugcgagcugcgggaguucgugaagaacaucgaccaggucuccagcgaagugcucgagggcuggcccgacucuuacaaaugcgauuauccugaauccuaccgcgggagcccgcugaaggacuuucacaugucugagcuguccugcaauaucacacuucucauuguuacgaucggagccaccaugcuggugcuggcugucacagugaccagccucuguauuuaucuggaucuucccugguaccugagaauggugugccaauggacacagacccggcgcagagcccggaacaucccucucgaagaacugcagagaaaucugcaguuccacgcguuuauuucuuauagcgagcaugacuccgccuggguuaaaagcgaacuuguccccuaccuggagaaggaagauauccaaaucugucuccacgagcgcaacuucgugccuggcaaaucuauuguggagaauaucauuaacugcaucgaaaaguccuauaagagcauuuuuguccugucccccaauuucgugcagucugaguggugucauuacgaacucuacuuugcucaccacaaccuguuccaugaggggagcaauaaccuuauccugauccuccuggaaccgauuccucagaauagcauccccaacaaauaucacaagcugaaagcccuuaugacgcagcggaccuaccugcaauggccuaaggagaaaucuaagagaggacucuucugggcuaauauucgcgccgccuuuaacaugaaacugacacucguuaccgagaauaacgacgucaagagcuga

SEQ ID NO: 9690 - protein, 796 aa, Artificial Sequence [sequence omitted]

SEQ ID NO: 9691 - RNA, 2391 nt, Artificial Sequence
  TLR6__Homo_sapiens__ABW37073
augaccaaagacaaagaaccuauuguuaaaagcuuccauuuuguuugccuuaugaucauaauaguuggaaccagaauccaguucuccgacggaaaugaauuugcaguagacaagucaaaaagaggucuuauucauguuccaaaagaccuaccgcugaaaaccaaagucuuagauaugucucagaacuacaucgcugagcuucaggucucugacaugagcuuucuaucagaguugacaguuuugagacuuucccauaacagaauccagcuacuugauuuaaguguuuucaaguucaaccaggauuuagaauauuuggauuuaucucauaaucaguugcaaaagauauccugccauccuacugugaguuucaggcauuuagaucucucauucaaugauuucaaggcccugcccaucuguaaggaauuuggcaacuuaucacaacugaauuucuugggauugagugcuaugaagcugcaaaaauuagauuugcugccaauugcucacuugcaucuaaguuauauccuucuggauuuaagaaauuauuauauaaaagaaaaugagacagaaagucuacaaauucugaaugcaaaaacccuucaccuuguuuuucacccaacuaguuuauucgcuauccaagugaacauaucaguuaauacuuuagggugcuuacaacugacuaauauuaaauugaaugaugacaacugucaaguuuucauuaaauuuuuaucagaacucaccagagguccaaccuuacugaauuuuacccucaaccacauagaaacgacuuggaaaugccuggucagagucuuucaauuucuuuggcccaaaccuguggaauaucucaauauuuacaauuuaacaauaauugaaagcauucgugaagaagauuuuacuuauucuaaaacgacauugaaagcauugacaauagaacauaucacgaaccaaguuuuucuguuuucacagacagcuuuguacaccauguuuucugagaugaacauuaugauguuaaccauuucagauacaccuuuuauacacaugcuguguccucaugcaccaagcacauucaaguuuuugaacuuuacgcagaacguuuucacagauaguauuuuugaaaaauguuccacguuaguuaaauuggagacacuuaucuuacaaaagaauggauuaaaagaccuuuucaaaguaggucucaugacgaaggauaugccuucuuuggaaauacuggauguuagcuggaauucuuuggaaucugguagacauaaggaaaacugcacuuggguugagaguauagugguguuaaauuugucuucaaauaugcuuacugacucuguuuucagauguuuaccucccaggaucaagguacuugaucuucacagcaauaaaauaaagagcguuccuaaacaagucguaaaacuggaagcuuugcaagaacucaauguugcuuucaauucuuuaacugaccuuccuggauguggcagcuuuagcagccuuucuguauugaucauugaucacaauucaguuucccacccaucggcugauuucuuccagagcugccagaagaugaggucaauaaaagcaggggacaauccauuccaauguaccugugagcuaagagaauuugucaaaaauauagaccaaguaucaagugaaguguuagagggcuggccugauucuuauaagugugacuacccagaaaguuauagaggaagcccacuaaaggacuuucacaugucugaauuauccugcaacauaacucugcugaucgucaccaucggugccaccaugcugguguuggcugugacugugaccucccucugcaucuacuuggaucugcccugguaucucaggauggugugccaguggacccagacucggcgcagggccaggaacauacccuuagaagaacuccaaagaaaccuccaguuucaugcuuuuauuucauauagugaacaugauucugccugggugaaaagugaauugguaccuuaccuagaaaaagaagauauacagauuugucuucaugagagaaacuuugucccuggcaagagcauuguggaaaauaucaucaacugcauugagaagaguuacaaguccaucuuuguuuugucucccaacuuuguccagagugaguggugccauuacgaacucuauuuugcccaucacaaucucuuucaugaaggaucuaauaacuuaauccucaucuuacuggaacccauuccacagaacagcauucccaacaaguaccacaagcugaaggcucucaugacgcagcggacuuauuugcaguggcccaaggagaaaagcaaacgugggcucuuuugggcuaacauuagagccgcuuuuaauaugaaauuaacacuagucacugaaaacaaugaugugaaaucuuaa

SEQ ID NO: 9692 - RNA, 2391 nt, Artificial Sequence
  derived and/or modified sequence opt1 from TLR6__Homo_sapiens__ABW37073
augaccaaggacaaggagcccaucgucaagagcuuccacuucgugugccugaugaucaucaucgugggcacccgcauccaguucuccgacgggaacgaguucgccguggacaagagcaagcggggccucauccacgucccgaaggaccugccccugaagacgaaggugcucgacaugucccagaacuacaucgccgagcuccaggugagcgacauguccuuccugagcgagcugaccguccugcgccugucccacaaccggauccagcuccuggaccugagcguguucaaguucaaccaggaccucgaguaccuggaccugucccacaaccagcuccagaagaucagcugccaccccaccguguccuuccgccaccuggaccugagcuucaacgacuucaaggcgcuccccaucugcaaggaguucgggaaccugucccagcugaacuuccucggccugagcgccaugaagcugcagaagcucgaccugcugccgaucgcccaccuccaccuguccuacauccugcucgaccugcggaacuacuacaucaaggagaacgagaccgagagccugcagauccucaacgccaagacgcugcaccuggucuuccaccccaccucccucuucgccauccaggugaacaucagcgugaacacccuggggugccugcagcucaccaacaucaagcugaacgacgacaacugccaggucuucaucaaguuccuguccgagcucacgcgcggccccacccugcugaacuucacccucaaccacaucgagaccacguggaagugccuggugcggguguuccaguuccuguggcccaagccggucgaguaccucaacaucuacaaccugaccaucaucgagagcauccgcgaggaggacuucaccuacagcaagaccacgcugaaggcgcugaccaucgagcacaucaccaaccagguguuccucuucucccagaccgcccuguacacgauguucagcgagaugaacaucaugaugcugaccaucuccgacacccccuucauccacaugcucugcccccacgcccccagcaccuucaaguuccugaacuucacgcagaacguguucaccgacuccaucuucgagaagugcagcacccuggucaagcucgagacccugauccugcagaagaacggccucaaggaccuguucaagguggggcugaugacgaaggacaugccgucccucgagauccuggacgugagcuggaacucccuggagagcggccggcacaaggagaacugcaccugggucgaguccaucguggugcucaaccugagcuccaacaugcugaccgacagcgucuuccgcugccucccgccccggaucaaggugcuggaccugcacuccaacaagaucaagagcguccccaagcaggucgugaagcucgaggcccugcaggagcugaacguggcguucaacucccucaccgaccugcccgggugcggcagcuucuccagccugagcgugcucaucaucgaccacaacuccgugagccaccccuccgccgacuucuuccagagcugccagaagaugcgcuccaucaaggccggggacaaccccuuccagugcacgugcgagcugcgggaguucgucaagaacaucgaccaggugagcuccgaggugcuggagggcuggcccgacagcuacaagugcgacuacccggaguccuaccgcggcagcccccucaaggacuuccacauguccgagcugagcugcaacaucacccugcucaucgucaccaucggggccaccaugcuggugcuggccgugacggucaccucccucugcaucuaccuggaccugcccugguaccuccggauggugugccaguggacccagacccgccggcgcgcgcggaacaucccccuggaggagcugcagcgcaaccuccaguuccacgccuucaucagcuacuccgagcacgacagcgccugggugaaguccgagcuggucccguaccuggagaaggaggacauccagaucugccuccacgagcggaacuucgugcccggcaagagcaucguggagaacaucaucaacugcaucgagaaguccuacaagagcaucuucguccugagccccaacuucgugcaguccgaguggugccacuacgagcuguacuucgcccaccacaaccucuuccacgaggggagcaacaaccugauccugauccuccuggagcccaucccgcagaacuccauccccaacaaguaccacaagcugaaggcccucaugacccagcgcacguaccugcaguggcccaaggagaaguccaagcgcggccuguucugggcgaacauccgggccgccuucaacaugaagcucacccuggugaccgagaacaacgacgucaagagcuga

SEQ ID NO: 9693 - RNA, 2391 nt, Artificial Sequence
  derived and/or modified sequence opt2 from TLR6__Homo_sapiens__ABW37073
augaccaaggacaaggagcccaucgucaaguccuuccacuucgucugccucaugaucaucaucgucggcacccgcauccaguucuccgacggcaacgaguucgccgucgacaaguccaagcgcggccucauccacguccccaaggaccucccccucaagaccaagguccucgacaugucccagaacuacaucgccgagcuccaggucuccgacauguccuuccucuccgagcucaccguccuccgccucucccacaaccgcauccagcuccucgaccucuccgucuucaaguucaaccaggaccucgaguaccucgaccucucccacaaccagcuccagaagaucuccugccaccccaccgucuccuuccgccaccucgaccucuccuucaacgacuucaaggcccuccccaucugcaaggaguucggcaaccucucccagcucaacuuccucggccucuccgccaugaagcuccagaagcucgaccuccuccccaucgcccaccuccaccucuccuacauccuccucgaccuccgcaacuacuacaucaaggagaacgagaccgagucccuccagauccucaacgccaagacccuccaccucgucuuccaccccaccucccucuucgccauccaggucaacaucuccgucaacacccucggcugccuccagcucaccaacaucaagcucaacgacgacaacugccaggucuucaucaaguuccucuccgagcucacccgcggccccacccuccucaacuucacccucaaccacaucgagaccaccuggaagugccucguccgcgucuuccaguuccucuggcccaagcccgucgaguaccucaacaucuacaaccucaccaucaucgaguccauccgcgaggaggacuucaccuacuccaagaccacccucaaggcccucaccaucgagcacaucaccaaccaggucuuccucuucucccagaccgcccucuacaccauguucuccgagaugaacaucaugaugcucaccaucuccgacacccccuucauccacaugcucugcccccacgcccccuccaccuucaaguuccucaacuucacccagaacgucuucaccgacuccaucuucgagaagugcuccacccucgucaagcucgagacccucauccuccagaagaacggccucaaggaccucuucaaggucggccucaugaccaaggacaugcccucccucgagauccucgacgucuccuggaacucccucgaguccggccgccacaaggagaacugcaccugggucgaguccaucgucguccucaaccucuccuccaacaugcucaccgacuccgucuuccgcugccuccccccccgcaucaagguccucgaccuccacuccaacaagaucaaguccguccccaagcaggucgucaagcucgaggcccuccaggagcucaacgucgccuucaacucccucaccgaccuccccggcugcggcuccuucuccucccucuccguccucaucaucgaccacaacuccgucucccaccccuccgccgacuucuuccaguccugccagaagaugcgcuccaucaaggccggcgacaaccccuuccagugcaccugcgagcuccgcgaguucgucaagaacaucgaccaggucuccuccgagguccucgagggcuggcccgacuccuacaagugcgacuaccccgaguccuaccgcggcuccccccucaaggacuuccacauguccgagcucuccugcaacaucacccuccucaucgucaccaucggcgccaccaugcucguccucgccgucaccgucaccucccucugcaucuaccucgaccuccccugguaccuccgcauggucugccaguggacccagacccgccgccgcgcccgcaacaucccccucgaggagcuccagcgcaaccuccaguuccacgccuucaucuccuacuccgagcacgacuccgccugggucaaguccgagcucguccccuaccucgagaaggaggacauccagaucugccuccacgagcgcaacuucguccccggcaaguccaucgucgagaacaucaucaacugcaucgagaaguccuacaaguccaucuucguccucucccccaacuucguccaguccgaguggugccacuacgagcucuacuucgcccaccacaaccucuuccacgagggcuccaacaaccucauccucauccuccucgagcccaucccccagaacuccauccccaacaaguaccacaagcucaaggcccucaugacccagcgcaccuaccuccaguggcccaaggagaaguccaagcgcggccucuucugggccaacauccgcgccgccuucaacaugaagcucacccucgucaccgagaacaacgacgucaaguccuga

SEQ ID NO: 9694 - RNA, 2391 nt, Artificial Sequence
  derived and/or modified sequence opt3 from TLR6__Homo_sapiens__ABW37073
augaccaaggacaaagagcccaucgugaaguccuuccacuuugucugccugaugauuauaaucguuggcacaaggauucaguucuccgaugggaacgaauuugccguggacaaaucuaagagaggacucauccauguaccuaaagaucuuccacugaagacuaagguguuggacaugucacaaaauuacauugcugaguuacaggucagugauaugagcuuccuguccgaacuaacggugcuccggcugucucacaaccgcauccagcuucuggacuugucgguuuuuaaauucaaucaggaucucgaguaucuggaccugucacauaaccaacuccagaagauaagcugucacccgaccgugaguuuucgacauuuagaucuguccuucaaugacuuuaaagcacuucccaucugcaaggaguucgguaacuugucucagcugaauuuucuaggccucagcgccaugaaacugcagaaacuugaucuguugccuauugcgcaccuccaccuguccuacaucuuacuggaccuccguaacuauuacauuaaggagaaugagacagaaucacuucaaauccugaacgcuaagacuuugcaucuagucuuccacccaaccagucuguuugccauacaggugaauauuagcguaaacacacucgggugucugcagcuuaccaauaucaagcugaacgaugacaauugccagguuuucauuaaauucuugucugagcucacuagaggacccacacuguuaaacuuuacccugaaccauaucgaaacgacuuggaagugucuagugagggucuuccaauuucucuggccuaaaccaguggaguaucugaauaucuacaaccuuaccauuauagaguccauccgggaagaggacuucacauauucaaagacuaccuugaaagcacugacaauugaacacaucaccaaucagguguuucucuucagccagacggcccuguacacuauguuuagugagaugaacauaaugaugcuuacaauuucugauacccccuucauccacaugcugugcccucaugcuccauccacuuuuaaguucuugaauuuuacacaaaacgucuucaccgacagcaucuuugaaaaguguucgacgcucguuaaacuggagaccuuaauucugcagaagaauggccuaaaagaucucuucaaggugggucugaugacaaaagacaugccgucucuugagaucuuggauguauccuggaacucacuggaaagugggcgccacaaggagaauugcacuuggguggaaagcauugucgugcucaaccuguccucuaauauguuaaccgacagcguuuucagaugucugcccccuaggauaaaggugcuugauuugcauucaaacaaaaucaagagugucccaaaacaggugguaaagcucgaggcacugcaggaacuaaauguugccuuuaacucccugacagaccuccccggaugcggcagcuucucuucacugagugugcuuauuaucgaucacaauagcgucucccauccuucugcugacuuuuuccaaucgugucagaaaaugcggagcaucaaggccggcgauaacccauuucagugcacuugcgaguugcgcgaguucgugaagaacauugaccaggucuccucagaagugcuggagggguggcccgacaguuacaaaugugauuauccggaaucuuaccgaggaagcccuuuaaaggacuuucacauguccgagcucucaugcaauauaacccugcuuaucguuacaauuggugcgaccaugcugguguuggcaguaacugucacgagccucuguaucuaucuggaucuacccugguaccugagaauggugugccaauggacacagaccaggcggcgugcccgcaacauuccacucgaagaacugcagagaaaucuucaguuccacgcuuuuaucucuuauuccgagcaugacagugccuggguuaaaagcgaauuggugccuuaccuggagaaggaagauauacaaaucuguuuacacgagaggaacuucguccccggcaaaucuauuguggagaauaucauuaacugcaucgaaaaguccuauaagucaauauuuguacucaguccaaauuucgugcagagcgaguggugucauuacgaacuguacuuugcacaccacaaccuuuuccaugaggggucgaauaaccugauucuaauccuccuggaacccauuccucagaauagcaucccaaacaaauaucacaaguugaaagcucugaugacucagcggaccuacuuacaauggccgaaggagaaaucuaagcgaggacucuucugggccaauauacgcgcggccuuuaacaugaaacugacacuuguuaccgagaauaacgacgucaagagcuga

SEQ ID NO: 9695 - RNA, 2391 nt, Artificial Sequence
  derived and/or modified sequence opt4 from TLR6__Homo_sapiens__ABW37073
augaccaaggacaaggagcccaucgugaagagcuuccacuucgugugccugaugaucaucaucgugggcaccagaauccaguucagcgacggcaacgaguucgccguggacaagagcaagagaggccugauccacgugcccaaggaccugccccugaagaccaaggugcuggacaugagccagaacuacaucgccgagcugcaggugagcgacaugagcuuccugagcgagcugaccgugcugagacugagccacaacagaauccagcugcuggaccugagcguguucaaguucaaccaggaccuggaguaccuggaccugagccacaaccagcugcagaagaucagcugccaccccaccgugagcuucagacaccuggaccugagcuucaacgacuucaaggcccugcccaucugcaaggaguucggcaaccugagccagcugaacuuccugggccugagcgccaugaagcugcagaagcuggaccugcugcccaucgcccaccugcaccugagcuacauccugcuggaccugagaaacuacuacaucaaggagaacgagaccgagagccugcagauccugaacgccaagacccugcaccugguguuccaccccaccagccuguucgccauccaggugaacaucagcgugaacacccugggcugccugcagcugaccaacaucaagcugaacgacgacaacugccagguguucaucaaguuccugagcgagcugaccagaggccccacccugcugaacuucacccugaaccacaucgagaccaccuggaagugccuggugagaguguuccaguuccuguggcccaagcccguggaguaccugaacaucuacaaccugaccaucaucgagagcaucagagaggaggacuucaccuacagcaagaccacccugaaggcccugaccaucgagcacaucaccaaccagguguuccuguucagccagaccgcccuguacaccauguucagcgagaugaacaucaugaugcugaccaucagcgacacccccuucauccacaugcugugcccccacgcccccagcaccuucaaguuccugaacuucacccagaacguguucaccgacagcaucuucgagaagugcagcacccuggugaagcuggagacccugauccugcagaagaacggccugaaggaccuguucaaggugggccugaugaccaaggacaugcccagccuggagauccuggacgugagcuggaacagccuggagagcggcagacacaaggagaacugcaccuggguggagagcaucguggugcugaaccugagcagcaacaugcugaccgacagcguguucagaugccugccccccagaaucaaggugcuggaccugcacagcaacaagaucaagagcgugcccaagcagguggugaagcuggaggcccugcaggagcugaacguggccuucaacagccugaccgaccugcccggcugcggcagcuucagcagccugagcgugcugaucaucgaccacaacagcgugagccaccccagcgccgacuucuuccagagcugccagaagaugagaagcaucaaggccggcgacaaccccuuccagugcaccugcgagcugagagaguucgugaagaacaucgaccaggugagcagcgaggugcuggagggcuggcccgacagcuacaagugcgacuaccccgagagcuacagaggcagcccccugaaggacuuccacaugagcgagcugagcugcaacaucacccugcugaucgugaccaucggcgccaccaugcuggugcuggccgugaccgugaccagccugugcaucuaccuggaccugcccugguaccugagaauggugugccaguggacccagaccagaagaagagccagaaacaucccccuggaggagcugcagagaaaccugcaguuccacgccuucaucagcuacagcgagcacgacagcgccugggugaagagcgagcuggugcccuaccuggagaaggaggacauccagaucugccugcacgagagaaacuucgugcccggcaagagcaucguggagaacaucaucaacugcaucgagaagagcuacaagagcaucuucgugcugagccccaacuucgugcagagcgaguggugccacuacgagcuguacuucgcccaccacaaccuguuccacgagggcagcaacaaccugauccugauccugcuggagcccaucccccagaacagcauccccaacaaguaccacaagcugaaggcccugaugacccagagaaccuaccugcaguggcccaaggagaagagcaagagaggccuguucugggccaacaucagagccgccuucaacaugaagcugacccuggugaccgagaacaacgacgugaagagcuga

SEQ ID NO: 9696 - RNA, 2391 nt, Artificial Sequence
  derived and/or modified sequence opt5 from TLR6__Homo_sapiens__ABW37073
augaccaaggacaaagagcccaucgugaaguccuuccacuuugugugccugaugauuaucauuguuggcacaagaauccaguucuccgaugggaacgaauuugccguggacaaaucuaagcggggacucauucaugugccuaaagaucugccgcuuaagacgaagguccuggacaugagccaaaauuacaucgcugagcuccagguguccgauaugucuuuccugagcgaacuuaccguucugcgccucucccacaacagaauccagcugcuggaccucucuguguuuaaauucaaucaggaucuggaguaucuugaccugagccauaaccaacuccagaagauuuccugucaccccacagucagcuuucggcaucuggaucuuucuuucaaugacuuuaaagcccugccuaucugcaaggaguucggcaaccucucccagcugaauuuucuggggcucagcgcgaugaaacugcagaagcucgaucugcuccccauugcucaucugcaccuuucuuacauccugcucgaccugcgcaacuauuacauuaaggagaaugagaccgaaucccugcaaauccucaacgccaaaacacugcaccuuguguuccacccuaccagccuguuugccauucagguuaauaucucugugaacacacucggaugucugcagcuuaccaauaucaagcugaacgaugacaauugccaggucuucauuaaauuccucuccgagcugacgagaggccccacccugcucaacuuuacacugaaccauaucgaaaccacauggaagugucuugugcggguguuccaauuucuguggccuaaaccggucgaguaucucaauauuuacaaccugaccaucauugagagcauccgcgaagaggacuucacguauuccaagacaacccugaaagcucuuacaaucgaacacauuaccaaucagguuuuucucuucucucagaccgcccuguacacaauguuuagcgagaugaacaucaugaugcugacgauuuccgauacccccuucauccacaugcucugcccucaugcucccagcacauuuaaguuccugaauuuuacccaaaacguguucacagacucuauuuuugaaaaguguuccacccuugugaaacuggagacgcucauccugcagaagaaugggcugaaagaucuuuucaaggucggacucaugacaaaagacaugccuagccuggagauccuggaugugucuuggaacagccucgaauccggcagacacaaggagaauugcaccuggguugaaucuauugugguccugaaccuuagcuccaauaugcugaccgacagcguguuccggugucuucccccgcgcaucaagguucuggaucugcauucuaacaaaauuaaguccgugccuaaacaggucgugaaacuugaggcccuccaggaacugaaugucgcguuuaacagccugacagaccuccccggcugcgggucuuucuccagccuguccgugcuuaucauugaucacaauucuguuagccauccuuccgccgacuuuuuccaaucuugucagaagaugagaagcaucaaggcuggagauaaccccuuucaguguaccugcgagcugcgggaguucgugaagaacauugaccaggucuccagcgaagugcucgagggcuggcccgacucuuacaaaugcgauuauccugaauccuaccgcgggagcccgcugaaggacuuucacaugucugagcuguccugcaauaucacacuucucaucguuacgauuggagccaccaugcuggugcuggcugucacagugaccagccucuguaucuaucuggaucuucccugguaccugagaauggugugccaauggacacagacccggcgcagagcccggaacauuccucucgaagaacugcagagaaaucugcaguuccacgcguuuaucucuuauagcgagcaugacuccgccuggguuaaaagcgaacuuguccccuaccuggagaaggaagauauucaaaucugucuccacgagcgcaacuucgugccuggcaaaucuaucguggagaauauuaucaacugcauugaaaaguccuauaagagcaucuuuguccugucccccaauuucgugcagucugaguggugucauuacgaacucuacuuugcucaccacaaccuguuccaugaggggagcaauaaccuuauucugauccuccuggaaccgaucccucagaauagcauucccaacaaauaucacaagcugaaagcccuuaugacgcagcggaccuaccugcaauggccuaaggagaaaucuaagagaggacucuucugggcuaauauccgcgccgccuuuaacaugaaacugacacucguuaccgagaauaacgacgucaagagcuga

SEQ ID NO: 9697 - protein, 796 aa, Artificial Sequence [sequence omitted]

SEQ ID NO: 9698 - RNA, 2391 nt, Artificial Sequence
  TLR6__Homo_sapiens__ABY67116
augaccaaagacaaagaaccuauuguuaaaagcuuccauuuuguuugccuuaugaucauaauaguuggaaccagaauccaguucuccgacggaaaugaauuugcaguagacaagucaaaaagaggucuuauucauguuccaaaagaccuaccgcugaaaaccaaagucuuagauaugucucagaacuacaucgcugagcuucaggucucugacaugagcuuucuaucagaguugacaguuuugagacuuucccauaacagaauccagcuacuugauuuaaguguuuucaaguucaaccaggauuuagaauauuuggauuuaucucauaaucaguugcaaaagauauccugccauccuauugugaguuucaggcauuuagaucucucauucaaugauuucaaggcccugcccaucuguaaggaauuuggcaacuuaucacaacugaauuucuugggauugagugcuaugaagcugcaaaaauuagauuugcugccaauugcucacuugcaucuaaguuauauccuucuggauuuaagaaauuauuauauaaaagaaaaugagacagaaagucuacaaauucugaaugcaaaaacccuucaccuuguuuuucacccaacuaguuuauucgcuauccaagugaacauaucaguuaauacuuuagggugcuuacaacugacuaauauuaaauugaaugaugacaacugucaaguuuucauuaaauuuuuaucagaacucaccagagguccaaccuuacugaauuuuacccucaaccacauagaaacgacuuggaaaugccuggucagagucuuucaauuucuuuggcccaaaccuguggaauaucucaauauuuacaauuuaacaauaauugaaagcauucgugaagaagauuuuacuuauucuaaaacgacauugaaagcauugacaauagaacauaucacgaaccaaguuuuucuguuuucacagacagcuuuguacaccguguuuucugagaugaacauuaugauguuaaccauuucagauacaccuuuuauacacaugcuguguccucaugcaccaagcacauucaaguuuuugaacuuuacgcagaacguuuucacagauaguauuuuugaaaaauguuccacguuaguuaaauuggagacacuuaucuuacaaaagaauggauuaaaagaccuuuucaaaguaggucucaugacgaaggauaugccuucuuuggaaauacuggauguuagcuggaauucuuuggaaucugguagacauaaggaaaacugcacuuggguugagaguauagugguguuaaauuugucuucaaauaugcuuacugacucuguuuucagauguuuaccucccaggaucaagguacuugaucuucacagcaauaaaauaaagagcauuccuaaacaagucuuaaaacuggaagcuuugcaagaacucaauguugcuuucaauucuuuaacugaccuuccuggauguggcagcuuuagcagccuuucuguauugaucauugaucacaauucaguuucccacccaucggcugauuucuuccagagcugccagaagaugaggucaauaaaagcaggggacaauccauuccaauguaccugugagcuaagagaauuugucaaaaauauagaccaaguaucaagugaaguguuagagggcuggccugauucuuauaagugugacuacccagaaaguuauagaggaagcccacuaaaggacuuucacaugucugaauuauccugcaacauaacucugcugaucgucaccaucggugccaccaugcugguguuggcugugacugugaccucccucugcaucuacuuggaucugcccugguaucucaggauggugugccaguggacccagacucggcgcagggccaggaacauacccuuagaagaacuccaaagaaaccuccaguuucaugcuuuuauuucauauagugaacaugauucugccugggugaaaagugaauugguaccuuaccuagaaaaagaagauauacagauuugucuucaugagagaaacuuugucccuggcaagagcauuguggaaaauaucaucaacugcauugagaagaguuacaaguccaucuuuguuuugucucccaacuuuguccagagugaguggugccauuacgaacucuauuuugcccaucacaaucucuuucaugaaggaucuaauaacuuaauccucaucuuacuggaacccauuccacagaacagcauucccaacaaguaccacaagcugaaggcucucaugacgcagcggacuuauuugcaguggcccaaggagaaaagcaaacgugggcucuuuugggcuaacauuagagccgcuuuuaauaugaaauuaacacuagucacugaaaacaaugaugugaaaucuuaa

SEQ ID NO: 9699 - RNA, 2391 nt, Artificial Sequence
  derived and/or modified sequence opt1 from TLR6__Homo_sapiens__ABY67116
augaccaaggacaaggagcccaucgucaagagcuuccacuucgugugccugaugaucaucaucgugggcacccgcauccaguucagcgacgggaacgaguucgccguggacaagagcaagcggggccucauccacgucccgaaggaccugccccugaagacgaaggugcucgacaugucccagaacuacaucgccgagcuccaggugagcgacauguccuuccugagcgagcugaccguccugcgccugucccacaaccggauccagcuccuggaccugagcguguucaaguucaaccaggaccucgaguaccuggaccugucccacaaccagcuccagaagaucagcugccaccccaucguguccuuccgccaccuggaccugagcuucaacgacuucaaggcgcuccccaucugcaaggaguucgggaaccugucccagcugaacuuccucggccugagcgccaugaagcugcagaagcucgaccugcugccgaucgcccaccuccaccuguccuacauccugcucgaccugcggaacuacuacaucaaggagaacgagaccgagagccugcagauccucaacgccaagacccugcaccuggucuuccaccccacgucccucuucgccauccaggugaacaucagcgugaacacccuggggugccugcagcucaccaacaucaagcugaacgacgacaacugccaggucuucaucaaguuccuguccgagcucacccgcggccccacgcugcugaacuucacccucaaccacaucgagaccaccuggaagugccuggugcggguguuccaguuccuguggcccaagccggucgaguaccucaacaucuacaaccugacgaucaucgagagcauccgcgaggaggacuucaccuacagcaagaccacccugaaggcgcugacgaucgagcacaucaccaaccagguguuccucuucucccagaccgcccuguacaccguguucagcgagaugaacaucaugaugcugacgaucuccgacacccccuucauccacaugcucugcccccacgcccccagcaccuucaaguuccugaacuucacccagaacgucuucacggacuccaucuucgagaagugcagcacccuggugaagcucgagacccugauccugcagaagaacggccucaaggaccuguucaagguggggcugaugaccaaggacaugccgucccucgagauccuggacgucagcuggaacucccuggagagcggccggcacaaggagaacugcacguggguggaguccaucgugguccucaaccugagcuccaacaugcugaccgacagcguguuccgcugccucccgccccggaucaagguccuggaccugcacuccaacaagaucaagagcauccccaagcagguccucaagcuggaggcccugcaggagcucaacguggcguucaacucccugaccgaccugcccgggugcggcagcuucuccagccucagcgugcugaucaucgaccacaacuccgugagccaccccuccgccgacuucuuccagagcugccagaagaugcgcuccaucaaggccggggacaaccccuuccagugcacgugcgagcugcgggaguucgugaagaacaucgaccaggucagcuccgaggugcucgagggcuggcccgacagcuacaagugcgacuacccggaguccuaccgcggcagcccccugaaggacuuccacauguccgagcugagcugcaacaucacccuccugaucgugaccaucggggccaccaugcugguccucgccgugaccgugacgucccugugcaucuaccuggaccuccccugguaccugcggauggucugccaguggacccagacccgccggcgcgcgcggaacaucccccuggaggagcuccagcgcaaccugcaguuccacgccuucaucagcuacuccgagcacgacagcgccugggugaaguccgagcuggugccguaccucgagaaggaggacauccagaucugccugcacgagcggaacuucguccccggcaagagcaucguggagaacaucaucaacugcaucgagaaguccuacaagagcaucuucgugcugagccccaacuucguccaguccgaguggugccacuacgagcucuacuucgcccaccacaaccuguuccacgaggggagcaacaaccugauccucauccugcuggagcccaucccgcagaacuccauccccaacaaguaccacaagcucaaggcccugaugacccagcgcaccuaccugcaguggcccaaggagaaguccaagcgcggccucuucugggcgaacauccgggccgccuucaacaugaagcugacgcuggugaccgagaacaacgacgugaaguccuga

SEQ ID NO: 9700 - RNA, 2391 nt, Artificial Sequence
  derived and/or modified sequence opt2 from TLR6__Homo_sapiens__ABY67116
augaccaaggacaaggagcccaucgucaaguccuuccacuucgucugccucaugaucaucaucgucggcacccgcauccaguucuccgacggcaacgaguucgccgucgacaaguccaagcgcggccucauccacguccccaaggaccucccccucaagaccaagguccucgacaugucccagaacuacaucgccgagcuccaggucuccgacauguccuuccucuccgagcucaccguccuccgccucucccacaaccgcauccagcuccucgaccucuccgucuucaaguucaaccaggaccucgaguaccucgaccucucccacaaccagcuccagaagaucuccugccaccccaucgucuccuuccgccaccucgaccucuccuucaacgacuucaaggcccuccccaucugcaaggaguucggcaaccucucccagcucaacuuccucggccucuccgccaugaagcuccagaagcucgaccuccuccccaucgcccaccuccaccucuccuacauccuccucgaccuccgcaacuacuacaucaaggagaacgagaccgagucccuccagauccucaacgccaagacccuccaccucgucuuccaccccaccucccucuucgccauccaggucaacaucuccgucaacacccucggcugccuccagcucaccaacaucaagcucaacgacgacaacugccaggucuucaucaaguuccucuccgagcucacccgcggccccacccuccucaacuucacccucaaccacaucgagaccaccuggaagugccucguccgcgucuuccaguuccucuggcccaagcccgucgaguaccucaacaucuacaaccucaccaucaucgaguccauccgcgaggaggacuucaccuacuccaagaccacccucaaggcccucaccaucgagcacaucaccaaccaggucuuccucuucucccagaccgcccucuacaccgucuucuccgagaugaacaucaugaugcucaccaucuccgacacccccuucauccacaugcucugcccccacgcccccuccaccuucaaguuccucaacuucacccagaacgucuucaccgacuccaucuucgagaagugcuccacccucgucaagcucgagacccucauccuccagaagaacggccucaaggaccucuucaaggucggccucaugaccaaggacaugcccucccucgagauccucgacgucuccuggaacucccucgaguccggccgccacaaggagaacugcaccugggucgaguccaucgucguccucaaccucuccuccaacaugcucaccgacuccgucuuccgcugccuccccccccgcaucaagguccucgaccuccacuccaacaagaucaaguccauccccaagcagguccucaagcucgaggcccuccaggagcucaacgucgccuucaacucccucaccgaccuccccggcugcggcuccuucuccucccucuccguccucaucaucgaccacaacuccgucucccaccccuccgccgacuucuuccaguccugccagaagaugcgcuccaucaaggccggcgacaaccccuuccagugcaccugcgagcuccgcgaguucgucaagaacaucgaccaggucuccuccgagguccucgagggcuggcccgacuccuacaagugcgacuaccccgaguccuaccgcggcuccccccucaaggacuuccacauguccgagcucuccugcaacaucacccuccucaucgucaccaucggcgccaccaugcucguccucgccgucaccgucaccucccucugcaucuaccucgaccuccccugguaccuccgcauggucugccaguggacccagacccgccgccgcgcccgcaacaucccccucgaggagcuccagcgcaaccuccaguuccacgccuucaucuccuacuccgagcacgacuccgccugggucaaguccgagcucguccccuaccucgagaaggaggacauccagaucugccuccacgagcgcaacuucguccccggcaaguccaucgucgagaacaucaucaacugcaucgagaaguccuacaaguccaucuucguccucucccccaacuucguccaguccgaguggugccacuacgagcucuacuucgcccaccacaaccucuuccacgagggcuccaacaaccucauccucauccuccucgagcccaucccccagaacuccauccccaacaaguaccacaagcucaaggcccucaugacccagcgcaccuaccuccaguggcccaaggagaaguccaagcgcggccucuucugggccaacauccgcgccgccuucaacaugaagcucacccucgucaccgagaacaacgacgucaaguccuga

SEQ ID NO: 9701 - RNA, 2391 nt, Artificial Sequence
  derived and/or modified sequence opt3 from TLR6__Homo_sapiens__ABY67116
augaccaaggacaaagagcccaucgucaagagcuuccacuuugugugccugaugauuauaaucguuggcacaaggauucaguucuccgaugggaacgaauuugccguggacaaaucuaagagaggacucauccauguaccuaaagaucuuccacugaagacuaagguguuggacaugucacaaaauuacauugcugaguuacaggucagugauaugagcuuccuguccgaacuaacggugcuccggcugucucacaaccgcauccagcuucuggacuugucgguuuuuaaauucaaucaggaucucgaguaucuggaccugucacauaaccaacuccagaagauaagcugucacccgaucgugaguuuucgacauuuagaucuguccuucaaugacuuuaaagcacuucccauuugcaaggaguucgguaacuugucucagcugaauuuucuaggccucagcgccaugaaacugcagaaacuugaucuguugccuaucgcgcaccuccaccuguccuacauuuuacuggaccuccguaacuauuacaucaaggaaaaugagaccgaaucacuucaaauacugaacgcuaaaacauugcaucuagucuuccacccaacuucccuguuugccauucaggugaauaucagcguaaacacccucgggugucugcagcuuacaaauauuaagcugaacgaugacaauugccagguuuucaucaaauucuugucugagcucaccagaggacccacucuguuaaacuuuacacugaaccauaucgaaaccacguggaagugucuagugagggucuuccaauuucucuggccuaaaccaguggaguaucugaauauuuacaaccuuacuauaaucgaguccauucgggaagaggacuucaccuauucaaagacaacuuugaaagcacugaccaucgaacacauaacaaaucagguguuucucuucagccagaccgcccuguacacggucuuuagugagaugaacauuaugaugcuuacuaucucugauacacccuucauccacaugcugugcccucaugcuccauccaccuuuaaguucuugaauuuuacucaaaacguuuucacagacagcauuuuugaaaaguguucgacccucgugaaacuggagacguuaauccugcagaagaauggccuaaaagaucucuucaagguaggucugaugaccaaagacaugccgucucuugagauuuuggauguguccuggaacucacuggaaagugggcgccacaaggagaauugcacaugggucgaaagcauagugguucucaaccuguccucuaauauguuaacugacagcguguucagaugucugcccccuaggaucaagguccuugauuugcauucaaacaaaauuaagaguaucccaaaacaggugcucaagcuggaggcacuacaggaacugaauguagccuuuaacucccucaccgaccugcccggaugcggcagcuucucuucacuuaguguuuugaucauugaucacaauagcgugucccauccuucugcugacuuuuuccaaucgugucagaaaaugcggagcauaaaggccggcgauaacccauuucagugcacaugcgagcugcgcgaguucgucaagaacaucgaccagguguccucagaagucuuagagggguggcccgacaguuacaaaugugauuauccggaaucuuaccgaggaagcccucucaaggacuuucacauguccgagcugucaugcaauauuacucuucugaucgugaccauuggugcgacaauguugguucucgcagugaccguaacuagccuguguaucuaucuagaucugcccugguaccucagaauggucugccaauggacgcagacaaggcggcgugcccgcaacauaccacuggaggaacuucagagaaauuugcaguuccacgcuuuuaucucuuauuccgagcaugacagugccugggugaaaagcgaacugguuccuuacuuagagaaggaagauauucaaaucugucuccacgagaggaacuucgugcccggcaaaucuauugucgagaauaucauaaacugcauugaaaaguccuauaagucaaucuuugugcugaguccaaauuucguacagagcgaguggugucauuacgaacuuuacuuugcacaccacaaccuguuccaugaggggucgaauaaccuaauucucauccuguuggaacccauaccucagaauaguaucccaaacaaauaucacaagcugaaggcuuuaaugacccagcggacuuaccuccaauggccgaaggagaaaucuaagcgaggacuguucugggccaauauucgcgcggccuuuaacaugaaacuuacccuggugacagagaauaacgacguuaagagcuga

SEQ ID NO: 9702 - RNA, 2391 nt, Artificial Sequence
  derived and/or modified sequence opt4 from TLR6__Homo_sapiens__ABY67116
augaccaaggacaaggagcccaucgugaagagcuuccacuucgugugccugaugaucaucaucgugggcaccagaauccaguucagcgacggcaacgaguucgccguggacaagagcaagagaggccugauccacgugcccaaggaccugccccugaagaccaaggugcuggacaugagccagaacuacaucgccgagcugcaggugagcgacaugagcuuccugagcgagcugaccgugcugagacugagccacaacagaauccagcugcuggaccugagcguguucaaguucaaccaggaccuggaguaccuggaccugagccacaaccagcugcagaagaucagcugccaccccaucgugagcuucagacaccuggaccugagcuucaacgacuucaaggcccugcccaucugcaaggaguucggcaaccugagccagcugaacuuccugggccugagcgccaugaagcugcagaagcuggaccugcugcccaucgcccaccugcaccugagcuacauccugcuggaccugagaaacuacuacaucaaggagaacgagaccgagagccugcagauccugaacgccaagacccugcaccugguguuccaccccaccagccuguucgccauccaggugaacaucagcgugaacacccugggcugccugcagcugaccaacaucaagcugaacgacgacaacugccagguguucaucaaguuccugagcgagcugaccagaggccccacccugcugaacuucacccugaaccacaucgagaccaccuggaagugccuggugagaguguuccaguuccuguggcccaagcccguggaguaccugaacaucuacaaccugaccaucaucgagagcaucagagaggaggacuucaccuacagcaagaccacccugaaggcccugaccaucgagcacaucaccaaccagguguuccuguucagccagaccgcccuguacaccguguucagcgagaugaacaucaugaugcugaccaucagcgacacccccuucauccacaugcugugcccccacgcccccagcaccuucaaguuccugaacuucacccagaacguguucaccgacagcaucuucgagaagugcagcacccuggugaagcuggagacccugauccugcagaagaacggccugaaggaccuguucaaggugggccugaugaccaaggacaugcccagccuggagauccuggacgugagcuggaacagccuggagagcggcagacacaaggagaacugcaccuggguggagagcaucguggugcugaaccugagcagcaacaugcugaccgacagcguguucagaugccugccccccagaaucaaggugcuggaccugcacagcaacaagaucaagagcauccccaagcaggugcugaagcuggaggcccugcaggagcugaacguggccuucaacagccugaccgaccugcccggcugcggcagcuucagcagccugagcgugcugaucaucgaccacaacagcgugagccaccccagcgccgacuucuuccagagcugccagaagaugagaagcaucaaggccggcgacaaccccuuccagugcaccugcgagcugagagaguucgugaagaacaucgaccaggugagcagcgaggugcuggagggcuggcccgacagcuacaagugcgacuaccccgagagcuacagaggcagcccccugaaggacuuccacaugagcgagcugagcugcaacaucacccugcugaucgugaccaucggcgccaccaugcuggugcuggccgugaccgugaccagccugugcaucuaccuggaccugcccugguaccugagaauggugugccaguggacccagaccagaagaagagccagaaacaucccccuggaggagcugcagagaaaccugcaguuccacgccuucaucagcuacagcgagcacgacagcgccugggugaagagcgagcuggugcccuaccuggagaaggaggacauccagaucugccugcacgagagaaacuucgugcccggcaagagcaucguggagaacaucaucaacugcaucgagaagagcuacaagagcaucuucgugcugagccccaacuucgugcagagcgaguggugccacuacgagcuguacuucgcccaccacaaccuguuccacgagggcagcaacaaccugauccugauccugcuggagcccaucccccagaacagcauccccaacaaguaccacaagcugaaggcccugaugacccagagaaccuaccugcaguggcccaaggagaagagcaagagaggccuguucugggccaacaucagagccgccuucaacaugaagcugacccuggugaccgagaacaacgacgugaagagcuga

SEQ ID NO: 9703 - RNA, 2391 nt, Artificial Sequence
  derived and/or modified sequence opt5 from TLR6__Homo_sapiens__ABY67116
augaccaaggacaaagagcccaucgugaaguccuuccacuuugucugccugaugauuaucauuguuggcacaagaauccaguucuccgaugggaacgaauuugccguggacaaaucuaagcggggacucauucaugugccuaaagaucugccgcuuaagacgaagguccuggacaugagccaaaauuacaucgcugagcuccagguguccgauaugucuuuccugagcgaacuuaccguucugcgccucucccacaacagaauccagcugcuggaccucucuguguuuaaauucaaucaggaucuggaguaucuugaccugagccauaaccaacuccagaagauuuccugucaccccaucgucagcuuucggcaucuggaucuuucuuucaaugacuuuaaagcccugccuauuugcaaggaguucggcaaccucucccagcugaauuuucuggggcucagcgcgaugaaacugcagaagcucgaucugcuccccaucgcucaucugcaccuuucuuacauucugcucgaccugcgcaacuauuacaucaaggagaaugagacagaaucccugcaaauucucaacgccaaaacccugcaccuuguguuccacccuacaagccuguuugccauccagguuaauaucucugugaacacccucggaugucugcagcuuacaaauauuaagcugaacgaugacaauugccaggucuucaucaaauuccucuccgagcugaccagaggccccacgcugcucaacuuuacccugaaccauauugaaacaaccuggaagugucuugugcggguguuccaauuucuguggccuaaaccggucgaguaucucaauaucuacaaccugacaauuaucgagagcauccgcgaagaggacuucaccuauuccaagacgacacugaaagcucuuaccauugaacacaucacaaaucagguuuuucucuucucucagaccgcccuguacaccguguuuagcgagaugaacauuaugaugcugacaaucuccgauacgcccuucauucacaugcucugcccucaugcucccagcaccuuuaaguuccugaauuuuacacaaaacguguucaccgacucuaucuuugaaaaguguuccacacuugucaaacuggagacccucauccugcagaagaaugggcugaaagaucuuuucaaggugggacucaugacgaaagacaugccuagccuggagauucuggauguuucuuggaacagccucgaauccggcagacacaaggagaauugcacauggguggaaucuaucgucgugcugaaccuuagcuccaauaugcugaccgacagcguuuuccggugucuucccccgcgcauuaaggugcuggaucugcauucuaacaaaaucaaguccauuccuaaacagguccuuaagcucgaggcccugcaggaacugaauguggcguuuaacagccucaccgaccugcccggcugcgggucuuucuccagccuuuccguccugaucauugaucacaauucugugagccauccuuccgccgacuuuuuccaaucuugucagaaaaugagaagcaucaaggcuggagauaaccccuuucagugcacaugcgagcuccgggaguucguuaagaacaucgaccagguguccagcgaaguccuggagggcuggcccgacucuuacaaaugugauuauccugaauccuaccgcgggagcccgcugaaggacuuucacaugucugagcuuuccugcaauauuacccuccugaucgugacaauuggagccacgaugcugguucucgcugugaccgucacaagccuguguaucuaucuugaucugcccugguaccucagaauggugugccaauggacccagacacggcgcagagcccggaacauuccucuggaagaacugcagagaaaucuucaguuccacgcguuuaucucuuauagcgagcaugacuccgccugggugaaaagcgaacugguucccuaccucgagaaggaagauauccaaauuugucugcacgagcgcaacuucgucccuggcaaaucuaucguggagaauauuaucaacugcauugaaaaguccuauaagagcaucuuugugcucucccccaauuucguccagucugaguggugucauuacgaacuguacuuugcucaccacaaccuuuuccaugaggggagcaauaaccugauccucauucugcuggaaccgaucccucagaauagcauucccaacaaauaucacaaacuuaaggcccugaugacccagcggacguaccuccaauggccuaaggagaaaucuaagagaggacuguucugggcuaauauccgcgccgccuuuaacaugaaacucacccuggugacagagaauaacgacguuaagagcuga

SEQ ID NO: 9704 - protein, 796 aa, Artificial Sequence [sequence omitted]

SEQ ID NO: 9705 - RNA, 2391 nt, Artificial Sequence
  TLR6__Homo_sapiens__AAY88753
augaccaaagacaaagaaccuauuguuaaaagcuuccauuuuguuugccuuaugaucauaauaguuggaaccagaauccaguucuccgacggaaaugaauuugcaguagacaagucaaaaagaggucuuauucauguuccaaaagaccuaccgcugaaaaccaaagucuuagauaugucucagaacuacaucgcugagcuucaggucucugacaugagcuuucuaucagaguugacaguuuugagacuuucccauaacagaauccagcuacuugauuuaaguguuuucaaguucaaccaggauuuagaauauuuggauuuaucucauaaucaguugcaaaagauauccugccauccuauugugaguuucaggcauuuagaucucucauucaaugauuucaaggcccugcccaucuguaaggaauuuggcaacuuaucacaacugaauuucuugggauugagugcuaugaagcugcaaaaauuagauuugcugccaauugcucacuugcaucuaaguuauauccuucuggauuuaagaaauuauuauauaaaagaaaaugagacagaaagucuacaaauucugaaugcaaaaacccuucaccuuguuuuucacccaacuaguuuauucgcuauccaagugaacauaucaguuaauacuuuagggugcuuacaacugacuaauauuaaauugaaugaugacaacugucaaguuuucauuaaauuuuuaucagaacucaccagagguccaaccuuacugaauuuuacccucaaccacauagaaacgacuuggaaaugccuggucagagucuuucaauuucuuuggcccaaaccuguggaauaucucaauauuuacaauuuaacaauaauugaaagcauucgugaagaagauuuuacuuauucuaaaacgacauugaaagcauugacaauagaacauaucacgaaccaaguuuuucuguuuucacagacagcuuuguacaccguguuuucugagaugaacauuaugauguuaaccauuucagauacaccuuuuauacacaugcuguguccucaugcaccaagcacauucaaguuuuugaacuuuacccagaacguuuucacagauaguauuuuugaaaaauguuccacguuaguuaaauuggagacacuuaucuuacaaaagaauggauuaaaagaccuuuucaaaguaggucucaugacgaaggauaugccuucuuuggaaauacuggauguuagcuggaauucuuuggaaucugguagacauaaagaaaacugcacuugggcugagaguauagugguguuaaauuugucuucaaauaugcuuacugacucuguuuucagauguuuaccucccaggaucaagguacuugaucuucacagcaauaaaauaaagagcauuccuaaacaagucguaaaacuggaagcuuugcaagaacucaauguugcuuucaauucuuuaacugaccuuccuggauguggcagcuuuagcagccuuucuguauugaucauugaucacaauucaguuucccacccaucggcugauuucuuccagagcugccagaagaugaggucaauaaaagcaggggacaauccauuccaauguaccugugagcuaagagaauuugucaaaaauauagaccaaguaucaagugaaguguuagagggcuggccugauucuuauaagugugacuacccagaaaguuauagaggaagcccacuaaaggacuuucacaugucugaauuauccugcaacauaacucugcugaucgucaccaucggugccaccaugcugguguuggcugugacugugaccucccucugcaucuacuuggaucugcccugguaucucaggauggugugccaguggacccagacucggcgcagggccaggaacauacccuuagaagaacuccaaagaaaccuccaguuucaugcuuuuauuucauauagugaacaugauucugccugggugaaaagugaauugguaccuuaccuagaaaaagaagauauacagauuugucuucaugagagaaacuuugucccuggcaagagcauuguggaaaauaucaucaacugcauugagaagaguuacaaguccaucuuuguuuugucucccaacuuuguccagagugaguggugccauuacgaacucuauuuugcccaucacaaucucuuucaugaaggaucuaauaacuuaauccucaucuuacuggaacccauuccacagaacagcauucccaacaaguaccacaagcugaaggcucucaugaugcagcggacuuauuugcaguggcccaaggagaaaagcaaacgugggcucuuuugggcuaacauuagagccgcuuuuaauaugaaauuaacacuagucacugaaaacaaugaugugaaaucuuaa

SEQ ID NO: 9706 - RNA, 2391 nt, Artificial Sequence
  derived and/or modified sequence opt1 from TLR6__Homo_sapiens__AAY88753
augaccaaggacaaggagcccaucgucaagagcuuccacuucgugugccugaugaucaucaucgugggcacccgcauccaguucagcgacgggaacgaguucgccguggacaagagcaagcggggccucauccacgucccgaaggaccugccccugaagacgaaggugcucgacaugucccagaacuacaucgccgagcuccaggugagcgacauguccuuccugagcgagcugaccguccugcgccugucccacaaccggauccagcuccuggaccugagcguguucaaguucaaccaggaccucgaguaccuggaccugucccacaaccagcuccagaagaucagcugccaccccaucguguccuuccgccaccuggaccugagcuucaacgacuucaaggcgcuccccaucugcaaggaguucgggaaccugucccagcugaacuuccucggccugagcgccaugaagcugcagaagcucgaccugcugccgaucgcccaccuccaccuguccuacauccugcucgaccugcggaacuacuacaucaaggagaacgagaccgagagccugcagauccucaacgccaagacccugcaccuggucuuccaccccacgucccucuucgccauccaggugaacaucagcgugaacacccuggggugccugcagcucaccaacaucaagcugaacgacgacaacugccaggucuucaucaaguuccuguccgagcucacccgcggccccacgcugcugaacuucacccucaaccacaucgagaccaccuggaagugccuggugcggguguuccaguuccuguggcccaagccggucgaguaccucaacaucuacaaccugacgaucaucgagagcauccgcgaggaggacuucaccuacagcaagaccacccugaaggcgcugacgaucgagcacaucaccaaccagguguuccucuucucccagaccgcccuguacaccguguucagcgagaugaacaucaugaugcugacgaucuccgacacccccuucauccacaugcucugcccccacgcccccagcaccuucaaguuccugaacuucacccagaacgucuucacggacuccaucuucgagaagugcagcacccuggugaagcucgagacccugauccugcagaagaacggccucaaggaccuguucaagguggggcugaugaccaaggacaugccgucccucgagauccuggacgucagcuggaacucccuggagagcggccggcacaaggagaacugcacgugggccgaguccaucguggugcucaaccugagcuccaacaugcugaccgacagcgucuuccgcugccucccgccccggaucaaggugcuggaccugcacuccaacaagaucaagagcauccccaagcaggucgugaagcucgaggcgcugcaggagcugaacguggccuucaacucccucaccgaccugcccgggugcggcagcuucuccagccugagcguccucaucaucgaccacaacuccgugagccaccccuccgccgacuucuuccagagcugccagaagaugcgcuccaucaaggccggggacaaccccuuccagugcacgugcgagcugcgggaguucgugaagaacaucgaccaggucagcuccgaggugcuggagggcuggcccgacagcuacaagugcgacuacccggaguccuaccgcggcagcccccucaaggacuuccacauguccgagcugagcugcaacaucacccugcucaucgugaccaucggggccaccaugcugguccuggcggugaccgugacgucccucugcaucuaccuggaccugcccugguaccuccggauggucugccaguggacccagacccgccggcgcgcccggaacaucccccuggaggagcugcagcgcaaccuccaguuccacgccuucaucagcuacuccgagcacgacagcgccugggugaaguccgagcuggugccguaccuggagaaggaggacauccagaucugccuccacgagcggaacuucguccccggcaagagcaucguggagaacaucaucaacugcaucgagaaguccuacaagagcaucuucgugcugagccccaacuucguccaguccgaguggugccacuacgagcuguacuucgcccaccacaaccucuuccacgaggggagcaacaaccugauccugauccuccuggagcccaucccgcagaacuccauccccaacaaguaccacaagcugaaggcgcucaugaugcagcgcaccuaccugcaguggcccaaggagaaguccaagcgcggccuguucugggccaacauccgggccgccuucaacaugaagcucacccuggugacggagaacaacgacgugaaguccuga

SEQ ID NO: 9707 - RNA, 2391 nt, Artificial Sequence
  derived and/or modified sequence opt2 from TLR6__Homo_sapiens__AAY88753
augaccaaggacaaggagcccaucgucaaguccuuccacuucgucugccucaugaucaucaucgucggcacccgcauccaguucuccgacggcaacgaguucgccgucgacaaguccaagcgcggccucauccacguccccaaggaccucccccucaagaccaagguccucgacaugucccagaacuacaucgccgagcuccaggucuccgacauguccuuccucuccgagcucaccguccuccgccucucccacaaccgcauccagcuccucgaccucuccgucuucaaguucaaccaggaccucgaguaccucgaccucucccacaaccagcuccagaagaucuccugccaccccaucgucuccuuccgccaccucgaccucuccuucaacgacuucaaggcccuccccaucugcaaggaguucggcaaccucucccagcucaacuuccucggccucuccgccaugaagcuccagaagcucgaccuccuccccaucgcccaccuccaccucuccuacauccuccucgaccuccgcaacuacuacaucaaggagaacgagaccgagucccuccagauccucaacgccaagacccuccaccucgucuuccaccccaccucccucuucgccauccaggucaacaucuccgucaacacccucggcugccuccagcucaccaacaucaagcucaacgacgacaacugccaggucuucaucaaguuccucuccgagcucacccgcggccccacccuccucaacuucacccucaaccacaucgagaccaccuggaagugccucguccgcgucuuccaguuccucuggcccaagcccgucgaguaccucaacaucuacaaccucaccaucaucgaguccauccgcgaggaggacuucaccuacuccaagaccacccucaaggcccucaccaucgagcacaucaccaaccaggucuuccucuucucccagaccgcccucuacaccgucuucuccgagaugaacaucaugaugcucaccaucuccgacacccccuucauccacaugcucugcccccacgcccccuccaccuucaaguuccucaacuucacccagaacgucuucaccgacuccaucuucgagaagugcuccacccucgucaagcucgagacccucauccuccagaagaacggccucaaggaccucuucaaggucggccucaugaccaaggacaugcccucccucgagauccucgacgucuccuggaacucccucgaguccggccgccacaaggagaacugcaccugggccgaguccaucgucguccucaaccucuccuccaacaugcucaccgacuccgucuuccgcugccuccccccccgcaucaagguccucgaccuccacuccaacaagaucaaguccauccccaagcaggucgucaagcucgaggcccuccaggagcucaacgucgccuucaacucccucaccgaccuccccggcugcggcuccuucuccucccucuccguccucaucaucgaccacaacuccgucucccaccccuccgccgacuucuuccaguccugccagaagaugcgcuccaucaaggccggcgacaaccccuuccagugcaccugcgagcuccgcgaguucgucaagaacaucgaccaggucuccuccgagguccucgagggcuggcccgacuccuacaagugcgacuaccccgaguccuaccgcggcuccccccucaaggacuuccacauguccgagcucuccugcaacaucacccuccucaucgucaccaucggcgccaccaugcucguccucgccgucaccgucaccucccucugcaucuaccucgaccuccccugguaccuccgcauggucugccaguggacccagacccgccgccgcgcccgcaacaucccccucgaggagcuccagcgcaaccuccaguuccacgccuucaucuccuacuccgagcacgacuccgccugggucaaguccgagcucguccccuaccucgagaaggaggacauccagaucugccuccacgagcgcaacuucguccccggcaaguccaucgucgagaacaucaucaacugcaucgagaaguccuacaaguccaucuucguccucucccccaacuucguccaguccgaguggugccacuacgagcucuacuucgcccaccacaaccucuuccacgagggcuccaacaaccucauccucauccuccucgagcccaucccccagaacuccauccccaacaaguaccacaagcucaaggcccucaugaugcagcgcaccuaccuccaguggcccaaggagaaguccaagcgcggccucuucugggccaacauccgcgccgccuucaacaugaagcucacccucgucaccgagaacaacgacgucaaguccuga

SEQ ID NO: 9708 - RNA, 2391 nt, Artificial Sequence
  derived and/or modified sequence opt3 from TLR6__Homo_sapiens__AAY88753
augaccaaggacaaagagcccaucgucaagagcuuccacuuugugugccugaugauuauaaucguuggcacaaggauucaguucuccgaugggaacgaauuugccguggacaaaucuaagagaggacucauccauguaccuaaagaucuuccacugaagacuaagguguuggacaugucacaaaauuacauugcugaguuacaggucagugauaugagcuuccuguccgaacuaacggugcuccggcugucucacaaccgcauccagcuucuggacuugucgguuuuuaaauucaaucaggaucucgaguaucuggaccugucacauaaccaacuccagaagauaagcugucacccgaucgugaguuuucgacauuuagaucuguccuucaaugacuuuaaagcacuucccauuugcaaggaguucgguaacuugucucagcugaauuuucuaggccucagcgccaugaaacugcagaaacuugaucuguugccuaucgcgcaccuccaccuguccuacauuuuacuggaccuccguaacuauuacaucaaggagaaugagaccgaaucacuucaaauacugaacgcuaagacauugcaucuagucuuccacccaacuucccuguuugccauucaggugaauaucagcguaaacacccucgggugucugcagcuuacaaauauuaagcugaacgaugacaauugccagguuuucaucaaauucuugucugagcucaccagaggacccacucuguuaaacuuuacacugaaccauaucgaaaccacguggaagugucuagugagggucuuccaauuucucuggccuaaaccaguggaguaucugaauauuuacaaccuuacuauaaucgaguccauucgggaagaggacuucaccuauucaaagacaacuuugaaagcacugaccaucgaacacauaacaaaucagguguuucucuucagccagaccgcccuguacacggucuuuagugagaugaacauuaugaugcuuacuaucucugauacacccuucauccacaugcugugcccucaugcuccauccaccuuuaaguucuugaauuuuacucaaaacguuuucacagacagcauuuuugaaaaguguucgacccucgugaaacuggagacguuaauccugcagaagaauggccuaaaagaucucuucaagguaggucugaugaccaaagacaugccgucucuugagauuuuggauguguccuggaacucacuggaaagugggcgccacaaggagaauugcacaugggcagaaagcauagucgugcucaaccuguccucuaauauguuaacugacagcguuuucagaugucugcccccuaggaucaaggugcuugauuugcauucaaacaaaauuaagaguaucccaaaacaggucgugaagcucgaggcccugcaggaacuaaauguagcuuuuaacucccugaccgaccuccccggaugcggcagcuucucuucacugaguguucuuaucauugaucacaauagcgugucccauccuucugccgacuuuuuccaaucgugucagaaaaugcggagcauaaaggcgggcgauaacccauuucagugcacaugcgaguugcgcgaguucgucaagaacaucgaccagguguccucagaaguccuggagggguggcccgacaguuacaaaugugauuauccggaaucuuaccgaggaagcccuuuaaaggacuuucacauguccgagcucucaugcaauauuacucugcuuaucgugaccauuggugcaacaaugcugguuuuggccgugaccguaacuagccucuguaucuaucuggaucuacccugguaccugagaauggucugccaauggacgcagacaaggcggcgugcucgcaacauaccacucgaagaacugcagagaaaucuucaguuccacgccuuuaucucuuauuccgagcaugacagugcaugggugaaaagcgaauugguuccuuaccuggagaaggaagauauucaaaucuguuuacacgagaggaacuucgugcccggcaaaucuauugucgagaauaucauaaacugcauugaaaaguccuauaagucaaucuuugugcucaguccaaauuucguacagagcgaguggugucauuacgaacuguacuuugcucaccacaaccuuuuccaugaggggucgaauaaccugauucuaauccuccuggaacccauaccucagaauaguaucccaaacaaauaucacaaguugaaagcccugaugaugcagcggaccuacuuacaauggccgaaggagaaaucuaagcgaggacucuucugggcgaauauucgcgccgcauuuaacaugaaacugacucuugugaccgagaauaacgacguuaagagcuga

SEQ ID NO: 9709 - RNA, 2391 nt, Artificial Sequence
  derived and/or modified sequence opt4 from TLR6__Homo_sapiens__AAY88753
augaccaaggacaaggagcccaucgugaagagcuuccacuucgugugccugaugaucaucaucgugggcaccagaauccaguucagcgacggcaacgaguucgccguggacaagagcaagagaggccugauccacgugcccaaggaccugccccugaagaccaaggugcuggacaugagccagaacuacaucgccgagcugcaggugagcgacaugagcuuccugagcgagcugaccgugcugagacugagccacaacagaauccagcugcuggaccugagcguguucaaguucaaccaggaccuggaguaccuggaccugagccacaaccagcugcagaagaucagcugccaccccaucgugagcuucagacaccuggaccugagcuucaacgacuucaaggcccugcccaucugcaaggaguucggcaaccugagccagcugaacuuccugggccugagcgccaugaagcugcagaagcuggaccugcugcccaucgcccaccugcaccugagcuacauccugcuggaccugagaaacuacuacaucaaggagaacgagaccgagagccugcagauccugaacgccaagacccugcaccugguguuccaccccaccagccuguucgccauccaggugaacaucagcgugaacacccugggcugccugcagcugaccaacaucaagcugaacgacgacaacugccagguguucaucaaguuccugagcgagcugaccagaggccccacccugcugaacuucacccugaaccacaucgagaccaccuggaagugccuggugagaguguuccaguuccuguggcccaagcccguggaguaccugaacaucuacaaccugaccaucaucgagagcaucagagaggaggacuucaccuacagcaagaccacccugaaggcccugaccaucgagcacaucaccaaccagguguuccuguucagccagaccgcccuguacaccguguucagcgagaugaacaucaugaugcugaccaucagcgacacccccuucauccacaugcugugcccccacgcccccagcaccuucaaguuccugaacuucacccagaacguguucaccgacagcaucuucgagaagugcagcacccuggugaagcuggagacccugauccugcagaagaacggccugaaggaccuguucaaggugggccugaugaccaaggacaugcccagccuggagauccuggacgugagcuggaacagccuggagagcggcagacacaaggagaacugcaccugggccgagagcaucguggugcugaaccugagcagcaacaugcugaccgacagcguguucagaugccugccccccagaaucaaggugcuggaccugcacagcaacaagaucaagagcauccccaagcagguggugaagcuggaggcccugcaggagcugaacguggccuucaacagccugaccgaccugcccggcugcggcagcuucagcagccugagcgugcugaucaucgaccacaacagcgugagccaccccagcgccgacuucuuccagagcugccagaagaugagaagcaucaaggccggcgacaaccccuuccagugcaccugcgagcugagagaguucgugaagaacaucgaccaggugagcagcgaggugcuggagggcuggcccgacagcuacaagugcgacuaccccgagagcuacagaggcagcccccugaaggacuuccacaugagcgagcugagcugcaacaucacccugcugaucgugaccaucggcgccaccaugcuggugcuggccgugaccgugaccagccugugcaucuaccuggaccugcccugguaccugagaauggugugccaguggacccagaccagaagaagagccagaaacaucccccuggaggagcugcagagaaaccugcaguuccacgccuucaucagcuacagcgagcacgacagcgccugggugaagagcgagcuggugcccuaccuggagaaggaggacauccagaucugccugcacgagagaaacuucgugcccggcaagagcaucguggagaacaucaucaacugcaucgagaagagcuacaagagcaucuucgugcugagccccaacuucgugcagagcgaguggugccacuacgagcuguacuucgcccaccacaaccuguuccacgagggcagcaacaaccugauccugauccugcuggagcccaucccccagaacagcauccccaacaaguaccacaagcugaaggcccugaugaugcagagaaccuaccugcaguggcccaaggagaagagcaagagaggccuguucugggccaacaucagagccgccuucaacaugaagcugacccuggugaccgagaacaacgacgugaagagcuga

SEQ ID NO: 9710 - RNA, 2391 nt, Artificial Sequence
  derived and/or modified sequence opt5 from TLR6__Homo_sapiens__AAY88753
augaccaaggacaaagagcccaucgugaaguccuuccacuuugucugccugaugauuaucauuguuggcacaagaauccaguucuccgaugggaacgaauuugccguggacaaaucuaagcggggacucauucaugugccuaaagaucugccgcuuaagacgaagguccuggacaugagccaaaauuacaucgcugagcuccagguguccgauaugucuuuccugagcgaacuuaccguucugcgccucucccacaacagaauccagcugcuggaccucucuguguuuaaauucaaucaggaucuggaguaucuugaccugagccauaaccaacuccagaagauuuccugucaccccaucgucagcuuucggcaucuggaucuuucuuucaaugacuuuaaagcccugccuauuugcaaggaguucggcaaccucucccagcugaauuuucuggggcucagcgcgaugaaacugcagaagcucgaucugcuccccaucgcucaucugcaccuuucuuacauucugcucgaccugcgcaacuauuacaucaaggagaaugagacagaaucccugcaaauucucaacgccaaaacccugcaccuuguguuccacccuacaagccuguuugccauccagguuaauaucucugugaacacccucggaugucugcagcuuacaaauauuaagcugaacgaugacaauugccaggucuucaucaaauuccucuccgagcugaccagaggccccacgcugcucaacuuuacccugaaccauauugaaacaaccuggaagugucuugugcggguguuccaauuucuguggccuaaaccggucgaguaucucaauaucuacaaccugacaauuaucgagagcauccgcgaagaggacuucaccuauuccaagacgacacugaaagcucuuaccauugaacacaucacaaaucagguuuuucucuucucucagaccgcccuguacaccguguuuagcgagaugaacauuaugaugcugacaaucuccgauacgcccuucauucacaugcucugcccucaugcucccagcaccuuuaaguuccugaauuuuacacaaaacguguucaccgacucuaucuuugaaaaguguuccacacuugucaaacuggagacccucauccugcagaagaaugggcugaaagaucuuuucaaggugggacucaugacgaaagacaugccuagccuggagauucuggauguuucuuggaacagccucgaauccggcagacacaaggagaauugcacaugggccgaaucuaucgugguccugaaccuuagcuccaauaugcugaccgacagcguguuccggugucuucccccgcgcauuaagguucuggaucugcauucuaacaaaaucaaguccauuccuaaacagguggucaaacuugaggcgcuccaggaacugaauguggccuuuaacagccugaccgaccuccccggcugcgggucuuucuccagccuguccguccuuaucauugaucacaauucugugagccauccuuccgcugacuuuuuccaaucuugucagaagaugagaagcaucaaggccggagauaaccccuuucagugcacaugcgagcugcgggaguucguuaagaacaucgaccagguguccagcgaaguccucgagggcuggcccgacucuuacaaaugugauuauccugaauccuaccgcgggagcccgcugaaggacuuucacaugucugagcuguccugcaauauuacccuucucaucgugacaauuggagcuacgaugcugguucuggccgugaccgucacaagccucuguaucuaucuggaucuucccugguaccugagaauggugugccaauggacccagacacggcgcagagcgcggaacauuccucucgaagaacugcagagaaaucugcaguuccacgccuuuaucucuuauagcgagcaugacuccgcuugggugaaaagcgaacuuguucccuaccuggagaaggaagauauccaaauuugucuccacgagcgcaacuucgucccuggcaaaucuaucguggagaauauuaucaacugcauugaaaaguccuauaagagcaucuuugugcugucccccaauuucguccagucugaguggugucauuacgaacucuacuuugcccaccacaaccuguuccaugaggggagcaauaaccuuauccugauucuccuggaaccgaucccucagaauagcauucccaacaaauaucacaagcugaaagcucuuaugaugcagcggaccuaccugcaauggccuaaggagaaaucuaagagaggacucuucugggccaauauccgcgccgcuuuuaacaugaaacugacgcucgugaccgagaauaacgacguuaagagcuga

SEQ ID NO: 9711 - protein, 796 aa, Artificial Sequence [sequence omitted]

SEQ ID NO: 9712 - RNA, 2391 nt, Artificial Sequence
  TLR6__Homo_sapiens__AAY88754
augaccaaagacaaagaaccuauuguuaaaagcuuccauuuuguuugccuuaugaucauaauaguuggaaccagaauccaguucuccgacggaaaugaauuugcaguagacaagucaaaaagaggucuuauucauguuccaaaagaccuaccgcugaaaaccaaagucuuagauaugucucagaacuacaucgcugagcuucaggucucugacaugagcuuucuaucagaguugacaguuuugagacuuucccauaacagaauccagcuacuugauuuaaguguuuucaaguucaaccaggauuuagaauauuuggauuuaucucauaaucaguugcaaaagauauccugccauccuauugugaguuucaggcauuuagaucucucauucaaugauuucaaggcccugcccaucuguaaggaauuuggcaacuuaucacaacugaauuucuugggauugagugcuaugaagcugcaaaaauuagauuugcugccaauugcucacuugcaucuaaguuauauccuucuggauuuaagaaauuauuauauaaaagaaaaugagacagaaagucuacaaauucugaaugcaaaaacccuucaccuuguuuuucacccaacuaguuuauucgcuauccaagugaacauaucaguuaauacuuuagggugcuuacaacugacuaauauuaaauugaaugaugacaacugucaaguuuucauuaaauuuuuaucagaacucaccagagguccaaccuuacugaauuuuacccucaaccacauagaaacgacuuggaaaugccuggucagagucuuucaauuucuuuggcccaaaccuguggaauaucucaauauuuacaauuuaacaauaauugaaagcauucgugaagaagauuuuacuuauucuaaaacgacauugaaagcauugacaauagaacauaucacgaaccaaguuuuucuguuuucacagacagcuuuguacaccguguuuucugagaugaacauuaugauguuaaccauuucagauacaccuuuuauacacaugcuguguccucaugcaccaagcacauucaaguuuuugaacuuuacccagaacguuuucacagauaguauuuuugaaaaauguuccacguuaguuaaauuggagacacuuaucuuacaaaagaauggauuaaaagaccuuuucaaaguaggucucaugacgaaggauaugccuucuuuggaaauacuggauguuagcuggaauucuuuggaaucugguagacauaaagaaaacugcacuuggguugagaguauagugguguuaaauuugucuucaaauaugcuuacugacucuguuuucagauguuuaccucccaggaucaagguacuugaucuucacagcaauaaaauaaagagcauuccuaaacaagucguaaaacuggaagcuuugcaagaacucaauguugcuuucaauucuuuaacugaccuuccuggauguggcagcuuuagcagccuuucuguauugaucauugaucacaauucaguuucccacccaucggcugauuucuuccagagcugccagaagaugaggucaauaaaagcaggggacaauccauuccaauguaccugugagcuaagagaauuugucaaaaauauagaccaaguaucaagugaaguguuagagggcuggccugauucuuauaagugugacuacccagaaaguuauagaggaagcccacuaaaggacuuucacaugucugaauuauccugcaacauaacucugcugaucgucaccaucggugccaccaugcugguguuggcugugacugugaccucccucugcaucuacuuggaucugcccugguaucucaggauggugugccaguggacccagacucggcgcagggccaggaacauacccuuagaagaacuccaaagaaaccuccaguuucaugcuuuuauuucauauagugaacaugauucugccugggugaaaagugaauugguaccuuaccuagaaaaagaagauauacagauuugucuucaugagagaaacuuugucccuggcaagagcauuguggaaaauaucaucaacugcauugagaagaguuacaaguccaucuuuguuuugucucccaacuuuguccagagugaguggugccauuacgaacucuauuuugcccaucacaaucucuuucaugaaggaucuaauaacuuaauccucaucuuacuggaacccauuccacagaacagcauucccaacaaguaccacaagcugaaggcucucaugacgcagcggacuuauuugcaguggcccaaggagaaaagcaaacgugggcucuuuugggcuaacauuagagccgcuuuuaauaugaaauuaacacuagucacugaaaacaaugaugugaaaucuuaa

SEQ ID NO: 9713 - RNA, 2391 nt, Artificial Sequence
  derived and/or modified sequence opt1 from TLR6__Homo_sapiens__AAY88754
augaccaaggacaaggagcccaucgucaagagcuuccacuucgugugccugaugaucaucaucgugggcacccgcauccaguucuccgacgggaacgaguucgccguggacaagagcaagcggggccucauccacgucccgaaggaccugccccugaagacgaaggugcucgacaugucccagaacuacaucgccgagcuccaggugagcgacauguccuuccugagcgagcugaccguccugcgccugucccacaaccggauccagcuccuggaccugagcguguucaaguucaaccaggaccucgaguaccuggaccugucccacaaccagcuccagaagaucagcugccaccccaucguguccuuccgccaccuggaccugagcuucaacgacuucaaggcgcuccccaucugcaaggaguucgggaaccugucccagcugaacuuccucggccugagcgccaugaagcugcagaagcucgaccugcugccgaucgcccaccuccaccuguccuacauccugcucgaccugcggaacuacuacaucaaggagaacgagaccgagagccugcagauccucaacgccaagacccugcaccuggucuuccaccccacgucccucuucgccauccaggugaacaucagcgugaacacccuggggugccugcagcucaccaacaucaagcugaacgacgacaacugccaggucuucaucaaguuccuguccgagcucacccgcggccccacgcugcugaacuucacccucaaccacaucgagaccaccuggaagugccuggugcggguguuccaguuccuguggcccaagccggucgaguaccucaacaucuacaaccugacgaucaucgagagcauccgcgaggaggacuucaccuacagcaagaccacccugaaggcgcugacgaucgagcacaucaccaaccagguguuccucuucucccagaccgcccuguacaccguguucagcgagaugaacaucaugaugcugacgaucuccgacacccccuucauccacaugcucugcccccacgcccccagcaccuucaaguuccugaacuucacccagaacgucuucacggacuccaucuucgagaagugcagcacccuggugaagcucgagacccugauccugcagaagaacggccucaaggaccuguucaagguggggcugaugaccaaggacaugccgucccucgagauccuggacgucagcuggaacucccuggagagcggccggcacaaggagaacugcacguggguggaguccaucgugguccucaaccugagcuccaacaugcugaccgacagcguguuccgcugccucccgccccggaucaagguccuggaccugcacuccaacaagaucaagagcauccccaagcaggucgugaagcucgaggcccugcaggagcugaacguggcguucaacucccucaccgaccugcccgggugcggcagcuucuccagccugagcgugcucaucaucgaccacaacuccgugagccaccccuccgccgacuucuuccagagcugccagaagaugcgcuccaucaaggccggggacaaccccuuccagugcacgugcgagcugcgggaguucgucaagaacaucgaccaggugagcuccgaggugcuggagggcuggcccgacagcuacaagugcgacuacccggaguccuaccgcggcagcccccucaaggacuuccacauguccgagcugagcugcaacaucacccugcucaucgucaccaucggggccaccaugcuggugcuggccgugaccgucacgucccucugcaucuaccuggaccugcccugguaccuccggauggugugccaguggacccagacccgccggcgcgcgcggaacaucccccuggaggagcugcagcgcaaccuccaguuccacgccuucaucagcuacuccgagcacgacagcgccugggugaaguccgagcuggucccguaccuggagaaggaggacauccagaucugccuccacgagcggaacuucgugcccggcaagagcaucguggagaacaucaucaacugcaucgagaaguccuacaagagcaucuucguccugagccccaacuucgugcaguccgaguggugccacuacgagcuguacuucgcccaccacaaccucuuccacgaggggagcaacaaccugauccugauccuccuggagcccaucccgcagaacuccauccccaacaaguaccacaagcugaaggcccucaugacccagcgcaccuaccugcaguggcccaaggagaaguccaagcgcggccuguucugggcgaacauccgggccgccuucaacaugaagcucacgcuggugaccgagaacaacgacgucaagagcuga

SEQ ID NO: 9714 - RNA, 2391 nt, Artificial Sequence
  derived and/or modified sequence opt2 from TLR6__Homo_sapiens__AAY88754
augaccaaggacaaggagcccaucgucaaguccuuccacuucgucugccucaugaucaucaucgucggcacccgcauccaguucuccgacggcaacgaguucgccgucgacaaguccaagcgcggccucauccacguccccaaggaccucccccucaagaccaagguccucgacaugucccagaacuacaucgccgagcuccaggucuccgacauguccuuccucuccgagcucaccguccuccgccucucccacaaccgcauccagcuccucgaccucuccgucuucaaguucaaccaggaccucgaguaccucgaccucucccacaaccagcuccagaagaucuccugccaccccaucgucuccuuccgccaccucgaccucuccuucaacgacuucaaggcccuccccaucugcaaggaguucggcaaccucucccagcucaacuuccucggccucuccgccaugaagcuccagaagcucgaccuccuccccaucgcccaccuccaccucuccuacauccuccucgaccuccgcaacuacuacaucaaggagaacgagaccgagucccuccagauccucaacgccaagacccuccaccucgucuuccaccccaccucccucuucgccauccaggucaacaucuccgucaacacccucggcugccuccagcucaccaacaucaagcucaacgacgacaacugccaggucuucaucaaguuccucuccgagcucacccgcggccccacccuccucaacuucacccucaaccacaucgagaccaccuggaagugccucguccgcgucuuccaguuccucuggcccaagcccgucgaguaccucaacaucuacaaccucaccaucaucgaguccauccgcgaggaggacuucaccuacuccaagaccacccucaaggcccucaccaucgagcacaucaccaaccaggucuuccucuucucccagaccgcccucuacaccgucuucuccgagaugaacaucaugaugcucaccaucuccgacacccccuucauccacaugcucugcccccacgcccccuccaccuucaaguuccucaacuucacccagaacgucuucaccgacuccaucuucgagaagugcuccacccucgucaagcucgagacccucauccuccagaagaacggccucaaggaccucuucaaggucggccucaugaccaaggacaugcccucccucgagauccucgacgucuccuggaacucccucgaguccggccgccacaaggagaacugcaccugggucgaguccaucgucguccucaaccucuccuccaacaugcucaccgacuccgucuuccgcugccuccccccccgcaucaagguccucgaccuccacuccaacaagaucaaguccauccccaagcaggucgucaagcucgaggcccuccaggagcucaacgucgccuucaacucccucaccgaccuccccggcugcggcuccuucuccucccucuccguccucaucaucgaccacaacuccgucucccaccccuccgccgacuucuuccaguccugccagaagaugcgcuccaucaaggccggcgacaaccccuuccagugcaccugcgagcuccgcgaguucgucaagaacaucgaccaggucuccuccgagguccucgagggcuggcccgacuccuacaagugcgacuaccccgaguccuaccgcggcuccccccucaaggacuuccacauguccgagcucuccugcaacaucacccuccucaucgucaccaucggcgccaccaugcucguccucgccgucaccgucaccucccucugcaucuaccucgaccuccccugguaccuccgcauggucugccaguggacccagacccgccgccgcgcccgcaacaucccccucgaggagcuccagcgcaaccuccaguuccacgccuucaucuccuacuccgagcacgacuccgccugggucaaguccgagcucguccccuaccucgagaaggaggacauccagaucugccuccacgagcgcaacuucguccccggcaaguccaucgucgagaacaucaucaacugcaucgagaaguccuacaaguccaucuucguccucucccccaacuucguccaguccgaguggugccacuacgagcucuacuucgcccaccacaaccucuuccacgagggcuccaacaaccucauccucauccuccucgagcccaucccccagaacuccauccccaacaaguaccacaagcucaaggcccucaugacccagcgcaccuaccuccaguggcccaaggagaaguccaagcgcggccucuucugggccaacauccgcgccgccuucaacaugaagcucacccucgucaccgagaacaacgacgucaaguccuga

SEQ ID NO: 9715 - RNA, 2391 nt, Artificial Sequence
  derived and/or modified sequence opt3 from TLR6__Homo_sapiens__AAY88754
augaccaaggacaaagagcccaucgucaagagcuuccacuuugugugccugaugauuauaaucguuggcacaaggauucaguucuccgaugggaacgaauuugccguggacaaaucuaagagaggacucauccauguaccuaaagaucuuccacugaagacuaagguguuggacaugucacaaaauuacauugcugaguuacaggucagugauaugagcuuccuguccgaacuaacggugcuccggcugucucacaaccgcauccagcuucuggacuugucgguuuuuaaauucaaucaggaucucgaguaucuggaccugucacauaaccaacuccagaagauaagcugucacccgaucgugaguuuucgacauuuagaucuguccuucaaugacuuuaaagcacuucccauuugcaaggaguucgguaacuugucucagcugaauuuucuaggccucagcgccaugaaacugcagaaacuugaucuguugccuaucgcgcaccuccaccuguccuacauuuuacuggaccuccguaacuauuacaucaaggagaaugagaccgaaucacuucaaauacugaacgcuaagacauugcaucuagucuuccacccaacuucccuguuugccauucaggugaauaucagcguaaacacccucgggugucugcagcuuacaaauauuaagcugaacgaugacaauugccagguuuucaucaaauucuugucugagcucaccagaggacccacucuguuaaacuuuacacugaaccauaucgaaaccacguggaagugucuagugagggucuuccaauuucucuggccuaaaccaguggaguaucugaauauuuacaaccuuacuauaaucgaguccauucgggaagaggacuucaccuauucaaagacaacuuugaaagcacugaccaucgaacacauaacaaaucagguguuucucuucagccagaccgcccuguacacggucuuuagugagaugaacauuaugaugcuuacuaucucugauacacccuucauccacaugcugugcccucaugcuccauccaccuuuaaguucuugaauuuuacucaaaacguuuucacagacagcauuuuugaaaaguguucgacccucgugaaacuggagacguuaauccugcagaagaauggccuaaaagaucucuucaagguaggucugaugaccaaagacaugccgucucuugagauuuuggauguguccuggaacucacuggaaagugggcgccacaaggagaauugcacaugggucgaaagcauagugguucucaaccuguccucuaauauguuaacugacagcguguucagaugucugcccccuaggaucaagguccuugauuugcauucaaacaaaauuaagaguaucccaaaacaggugguaaagcucgaggcacugcaggaacuaaauguugccuuuaacucccugaccgaccuccccggaugcggcagcuucucuucacugagugugcuuaucauugaucacaauagcgucucccauccuucugcugacuuuuuccaaucgugucagaaaaugcggagcauaaaggccggcgauaacccauuucagugcacaugcgaguugcgcgaguucgugaagaacaucgaccaggucuccucagaagugcuggagggguggcccgacaguuacaaaugugauuauccggaaucuuaccgaggaagcccuuuaaaggacuuucacauguccgagcucucaugcaauauuacucugcuuaucguuaccauuggugcgacaaugcugguguuggcaguaaccgucacuagccucuguaucuaucuggaucuacccugguaccugagaauggugugccaauggacgcagacaaggcggcgugcccgcaacauaccacucgaagaacugcagagaaaucuucaguuccacgcuuuuaucucuuauuccgagcaugacagugccuggguuaaaagcgaauuggugccuuaccuggagaaggaagauauucaaaucuguuuacacgagaggaacuucguccccggcaaaucuauuguggagaauaucauaaacugcauugaaaaguccuauaagucaaucuuuguacucaguccaaauuucgugcagagcgaguggugucauuacgaacuguacuuugcacaccacaaccuuuuccaugaggggucgaauaaccugauucuaauccuccuggaacccauaccucagaauaguaucccaaacaaauaucacaaguugaaagcucugaugacccagcggacuuacuuacaauggccgaaggagaaaucuaagcgaggacucuucugggccaauauucgcgcggccuuuaacaugaaacugacccuuguuacagagaauaacgacgucaagagcuga

SEQ ID NO: 9716 - RNA, 2391 nt, Artificial Sequence
  derived and/or modified sequence opt4 from TLR6__Homo_sapiens__AAY88754
augaccaaggacaaggagcccaucgugaagagcuuccacuucgugugccugaugaucaucaucgugggcaccagaauccaguucagcgacggcaacgaguucgccguggacaagagcaagagaggccugauccacgugcccaaggaccugccccugaagaccaaggugcuggacaugagccagaacuacaucgccgagcugcaggugagcgacaugagcuuccugagcgagcugaccgugcugagacugagccacaacagaauccagcugcuggaccugagcguguucaaguucaaccaggaccuggaguaccuggaccugagccacaaccagcugcagaagaucagcugccaccccaucgugagcuucagacaccuggaccugagcuucaacgacuucaaggcccugcccaucugcaaggaguucggcaaccugagccagcugaacuuccugggccugagcgccaugaagcugcagaagcuggaccugcugcccaucgcccaccugcaccugagcuacauccugcuggaccugagaaacuacuacaucaaggagaacgagaccgagagccugcagauccugaacgccaagacccugcaccugguguuccaccccaccagccuguucgccauccaggugaacaucagcgugaacacccugggcugccugcagcugaccaacaucaagcugaacgacgacaacugccagguguucaucaaguuccugagcgagcugaccagaggccccacccugcugaacuucacccugaaccacaucgagaccaccuggaagugccuggugagaguguuccaguuccuguggcccaagcccguggaguaccugaacaucuacaaccugaccaucaucgagagcaucagagaggaggacuucaccuacagcaagaccacccugaaggcccugaccaucgagcacaucaccaaccagguguuccuguucagccagaccgcccuguacaccguguucagcgagaugaacaucaugaugcugaccaucagcgacacccccuucauccacaugcugugcccccacgcccccagcaccuucaaguuccugaacuucacccagaacguguucaccgacagcaucuucgagaagugcagcacccuggugaagcuggagacccugauccugcagaagaacggccugaaggaccuguucaaggugggccugaugaccaaggacaugcccagccuggagauccuggacgugagcuggaacagccuggagagcggcagacacaaggagaacugcaccuggguggagagcaucguggugcugaaccugagcagcaacaugcugaccgacagcguguucagaugccugccccccagaaucaaggugcuggaccugcacagcaacaagaucaagagcauccccaagcagguggugaagcuggaggcccugcaggagcugaacguggccuucaacagccugaccgaccugcccggcugcggcagcuucagcagccugagcgugcugaucaucgaccacaacagcgugagccaccccagcgccgacuucuuccagagcugccagaagaugagaagcaucaaggccggcgacaaccccuuccagugcaccugcgagcugagagaguucgugaagaacaucgaccaggugagcagcgaggugcuggagggcuggcccgacagcuacaagugcgacuaccccgagagcuacagaggcagcccccugaaggacuuccacaugagcgagcugagcugcaacaucacccugcugaucgugaccaucggcgccaccaugcuggugcuggccgugaccgugaccagccugugcaucuaccuggaccugcccugguaccugagaauggugugccaguggacccagaccagaagaagagccagaaacaucccccuggaggagcugcagagaaaccugcaguuccacgccuucaucagcuacagcgagcacgacagcgccugggugaagagcgagcuggugcccuaccuggagaaggaggacauccagaucugccugcacgagagaaacuucgugcccggcaagagcaucguggagaacaucaucaacugcaucgagaagagcuacaagagcaucuucgugcugagccccaacuucgugcagagcgaguggugccacuacgagcuguacuucgcccaccacaaccuguuccacgagggcagcaacaaccugauccugauccugcuggagcccaucccccagaacagcauccccaacaaguaccacaagcugaaggcccugaugacccagagaaccuaccugcaguggcccaaggagaagagcaagagaggccuguucugggccaacaucagagccgccuucaacaugaagcugacccuggugaccgagaacaacgacgugaagagcuga

SEQ ID NO: 9717 - RNA, 2391 nt, Artificial Sequence
  derived and/or modified sequence opt5 from TLR6__Homo_sapiens__AAY88754
augaccaaggacaaagagcccaucgugaaguccuuccacuuugugugccugaugauuaucauuguuggcacaagaauccaguucuccgaugggaacgaauuugccguggacaaaucuaagcggggacucauucaugugccuaaagaucugccgcuuaagacgaagguccuggacaugagccaaaauuacaucgcugagcuccagguguccgauaugucuuuccugagcgaacuuaccguucugcgccucucccacaacagaauccagcugcuggaccucucuguguuuaaauucaaucaggaucuggaguaucuugaccugagccauaaccaacuccagaagauuuccugucaccccaucgucagcuuucggcaucuggaucuuucuuucaaugacuuuaaagcccugccuauuugcaaggaguucggcaaccucucccagcugaauuuucuggggcucagcgcgaugaaacugcagaagcucgaucugcuccccaucgcucaucugcaccuuucuuacauucugcucgaccugcgcaacuauuacaucaaggagaaugagacagaaucccugcaaauucucaacgccaaaacccugcaccuuguguuccacccuacaagccuguuugccauccagguuaauaucucugugaacacccucggaugucugcagcuuacaaauauuaagcugaacgaugacaauugccaggucuucaucaaauuccucuccgagcugaccagaggccccacgcugcucaacuuuacccugaaccauauugaaacaaccuggaagugucuugugcggguguuccaauuucuguggccuaaaccggucgaguaucucaauaucuacaaccugacaauuaucgagagcauccgcgaagaggacuucaccuauuccaagacgacacugaaagcucuuaccauugaacacaucacaaaucagguuuuucucuucucucagaccgcccuguacaccguguuuagcgagaugaacauuaugaugcugacaaucuccgauacgcccuucauucacaugcucugcccucaugcucccagcaccuuuaaguuccugaauuuuacacaaaacguguucaccgacucuaucuuugaaaaguguuccacacuugucaaacuggagacccucauccugcagaagaaugggcugaaagaucuuuucaaggugggacucaugacgaaagacaugccuagccuggagauucuggauguuucuuggaacagccucgaauccggcagacacaaggagaauugcacauggguggaaucuaucgucgugcugaaccuuagcuccaauaugcugaccgacagcguuuuccggugucuucccccgcgcauuaaggugcuggaucugcauucuaacaaaaucaaguccauuccuaaacaggucgugaaacuugaggcccuccaggaacugaaugucgcguuuaacagccugaccgaccuccccggcugcgggucuuucuccagccuguccgugcuuaucauugaucacaauucuguuagccauccuuccgccgacuuuuuccaaucuugucagaagaugagaagcaucaaggcuggagauaaccccuuucagugcacaugcgagcugcgggaguucgugaagaacaucgaccaggucuccagcgaagugcucgagggcuggcccgacucuuacaaaugugauuauccugaauccuaccgcgggagcccgcugaaggacuuucacaugucugagcuguccugcaauauuacccuucucaucguuacaauuggagccacgaugcuggugcuggcugucaccgugacaagccucuguaucuaucuggaucuucccugguaccugagaauggugugccaauggacccagacacggcgcagagcccggaacauuccucucgaagaacugcagagaaaucugcaguuccacgcguuuaucucuuauagcgagcaugacuccgccuggguuaaaagcgaacuuguccccuaccuggagaaggaagauauccaaauuugucuccacgagcgcaacuucgugccuggcaaaucuaucguggagaauauuaucaacugcauugaaaaguccuauaagagcaucuuuguccugucccccaauuucgugcagucugaguggugucauuacgaacucuacuuugcucaccacaaccuguuccaugaggggagcaauaaccuuauccugauucuccuggaaccgaucccucagaauagcauucccaacaaauaucacaagcugaaagcccuuaugacccagcggacguaccugcaauggccuaaggagaaaucuaagagaggacucuucugggcuaauauccgcgccgccuuuaacaugaaacugacccucguuacagagaauaacgacgucaagagcuga

SEQ ID NO: 9718 - protein, 796 aa, Artificial Sequence [sequence omitted]

SEQ ID NO: 9719 - RNA, 2391 nt, Artificial Sequence
  TLR6__Homo_sapiens__AAY88755
augaccaaagacaaagaaccuauuguuaaaagcuuccauuuuguuugccuuaugaucauaauaguuggaaccagaauccaguucuccgacggaaaugaauuugcaguagacaagucaaaaagaggucuuauucauguuccaaaagaccuaccgcugaaaaccaaagucuuagauaugucucagaacuacaucgcugagcuucaggucucugacaugagcuuucuaucagaguugacaguuuugagacuuucccauaacagaauccagcuacuugauuuaaguguuuucaaguucaaccaggauuuagaauauuuggauuuaucucauaaucaguugcaaaagauauccugccauccuauugugaguuucaggcauuuagaucucucauucaaugauuucaaggcccugcccaucuguaaggaauuuggcaacuuaucacaacugaauuucuugggauugagugcuaugaagcugcaaaaauuagauuugcugccaauugcucacuugcaucuaaguuauauccuucuggauuuaagaaauuauuauauaaaagaaaaugagacagaaagucuacaaauucugaaugcaaaaacccuucaccuuguuuuucacccaacuaguuuauucgcuauccaagugaacauaucaguuaauacuuuagggugcuuacaacugacuaauauuaaauugaaugaugacaacugucaaguuuucauuaaauuuuuaucagaacucaccagagguccaaccuuacugaauuuuacccucaaccacauagaaacgacuuggaaaugccuggucagagucuuucaauuucuuuggcccaaaccuguggaauaucucaauauuuacaauuuaacaauaauugaaagcauucgugaagaagauuuuacuuauucuaaaacgacauugaaagcauugacaauagaacauaucacgaaccaaguuuuucuguuuucacagacagcuuuguacaccguguuuucugagaugaacauuaugauguuaaccauuucagauacaccuuuuauacacaugcuguguccucaugcaccaagcacauucaaguuuuugaacuuuacccagaacguuuucacagauaguauuuuugaaaaauguuccacguuaguuaaauuggagacacuuaucuuacaaaagaauggauuaaaagaccuuuucaaaguaggucucaugacgaaggauaugccuucuuuggaaauacuggauguuagcuggaauucuuuggaaucugguagacauaaagaaaacugcacuuggguugagaguauagugguguuaaauuugucuucaaauaugcuuacugacucuguuuucagauguuuaccucccaggaucaagguacuugaucuucacagcaauaaaauaaagagcauuccuaaacaagucguaaaacuggaagcuuugcaagaacucaauguugcuuucaauucuuuaacugaccuuccuggauguggcagcuuuagcagccuuucuguauugaucauugaucacaauucaguuucccacccaucggcugauuucuuccagagcugccagaagaugaggucaauaaaagcaggggacaauccauuccaauguaccugugagcuaagagaauuugucaaaaauauagaccaaguaucaagugaaguguuagagggcuggccugauucuuauaagugugacuacccagaaaguuauagaggaagcccacuaaaggacuuucacaugucugaauuauccugcaacauaacucugcugaucgucaccaucggugccaccaugcugguguuggcugugacugugaccucccucugcaucuacuuggaucugcccugguaucucaggauggugugccaguggacccagacucggcgcagggccaggaacauacccuuagaagaacuccaaagaaaccuccaguuucaugcuuuuauuucauauagugaacaugauucugccugggugaaaagugaauugguaccuuaccuagaaaaagaagauauacagauuugucuucaugagagaaacuuugucccuggcaagagcauuguggaaaauaucaucaacugcauugagaagaguuacaaguccaucuuuguuuugucucccaacuuuguccagagugaguggugccauuacgaacucuauuuugcccaucacaaucucuuucaugaaggaucuaauaacuuaauccucaucuuacuggaacccauuccacagaacagcauucccaacaaguaccacaagcugaaggcucucaugaugcagcggacuuauuugcaguggcccaaggagaaaagcaaacgugggcucuuuugggcuaacauuagagccgcuuuuaauaugaaauuaacacuagucacugaaaacaaugaugugaaaucuuaa

SEQ ID NO: 9720 - RNA, 2391 nt, Artificial Sequence
  derived and/or modified sequence opt1 from TLR6__Homo_sapiens__AAY88755
augaccaaggacaaggagcccaucgucaagagcuuccacuucgugugccugaugaucaucaucgugggcacccgcauccaguucuccgacgggaacgaguucgccguggacaagagcaagcggggccucauccacgucccgaaggaccugccccugaagacgaaggugcucgacaugucccagaacuacaucgccgagcuccaggugagcgacauguccuuccugagcgagcugaccguccugcgccugucccacaaccggauccagcuccuggaccugagcguguucaaguucaaccaggaccucgaguaccuggaccugucccacaaccagcuccagaagaucagcugccaccccaucguguccuuccgccaccuggaccugagcuucaacgacuucaaggcgcuccccaucugcaaggaguucgggaaccugucccagcugaacuuccucggccugagcgccaugaagcugcagaagcucgaccugcugccgaucgcccaccuccaccuguccuacauccugcucgaccugcggaacuacuacaucaaggagaacgagaccgagagccugcagauccucaacgccaagacccugcaccuggucuuccaccccacgucccucuucgccauccaggugaacaucagcgugaacacccuggggugccugcagcucaccaacaucaagcugaacgacgacaacugccaggucuucaucaaguuccuguccgagcucacccgcggccccacgcugcugaacuucacccucaaccacaucgagaccaccuggaagugccuggugcggguguuccaguuccuguggcccaagccggucgaguaccucaacaucuacaaccugacgaucaucgagagcauccgcgaggaggacuucaccuacagcaagaccacccugaaggcgcugacgaucgagcacaucaccaaccagguguuccucuucucccagaccgcccuguacaccguguucagcgagaugaacaucaugaugcugacgaucuccgacacccccuucauccacaugcucugcccccacgcccccagcaccuucaaguuccugaacuucacccagaacgucuucacggacuccaucuucgagaagugcagcacccuggugaagcucgagacccugauccugcagaagaacggccucaaggaccuguucaagguggggcugaugaccaaggacaugccgucccucgagauccuggacgucagcuggaacucccuggagagcggccggcacaaggagaacugcacguggguggaguccaucgugguccucaaccugagcuccaacaugcugaccgacagcguguuccgcugccucccgccccggaucaagguccuggaccugcacuccaacaagaucaagagcauccccaagcaggucgugaagcucgaggcccugcaggagcugaacguggcguucaacucccucaccgaccugcccgggugcggcagcuucuccagccugagcgugcucaucaucgaccacaacuccgugagccaccccuccgccgacuucuuccagagcugccagaagaugcgcuccaucaaggccggggacaaccccuuccagugcacgugcgagcugcgggaguucgucaagaacaucgaccaggugagcuccgaggugcuggagggcuggcccgacagcuacaagugcgacuacccggaguccuaccgcggcagcccccucaaggacuuccacauguccgagcugagcugcaacaucacccugcucaucgucaccaucggggccaccaugcuggugcuggccgugaccgucacgucccucugcaucuaccuggaccugcccugguaccuccggauggugugccaguggacccagacccgccggcgcgcgcggaacaucccccuggaggagcugcagcgcaaccuccaguuccacgccuucaucagcuacuccgagcacgacagcgccugggugaaguccgagcuggucccguaccuggagaaggaggacauccagaucugccuccacgagcggaacuucgugcccggcaagagcaucguggagaacaucaucaacugcaucgagaaguccuacaagagcaucuucguccugagccccaacuucgugcaguccgaguggugccacuacgagcuguacuucgcccaccacaaccucuuccacgaggggagcaacaaccugauccugauccuccuggagcccaucccgcagaacuccauccccaacaaguaccacaagcugaaggcccucaugaugcagcgcaccuaccugcaguggcccaaggagaaguccaagcgcggccuguucugggcgaacauccgggccgccuucaacaugaagcucacccuggugacggagaacaacgacgucaagagcuga

SEQ ID NO: 9721 - RNA, 2391 nt, Artificial Sequence
  derived and/or modified sequence opt2 from TLR6__Homo_sapiens__AAY88755
augaccaaggacaaggagcccaucgucaaguccuuccacuucgucugccucaugaucaucaucgucggcacccgcauccaguucuccgacggcaacgaguucgccgucgacaaguccaagcgcggccucauccacguccccaaggaccucccccucaagaccaagguccucgacaugucccagaacuacaucgccgagcuccaggucuccgacauguccuuccucuccgagcucaccguccuccgccucucccacaaccgcauccagcuccucgaccucuccgucuucaaguucaaccaggaccucgaguaccucgaccucucccacaaccagcuccagaagaucuccugccaccccaucgucuccuuccgccaccucgaccucuccuucaacgacuucaaggcccuccccaucugcaaggaguucggcaaccucucccagcucaacuuccucggccucuccgccaugaagcuccagaagcucgaccuccuccccaucgcccaccuccaccucuccuacauccuccucgaccuccgcaacuacuacaucaaggagaacgagaccgagucccuccagauccucaacgccaagacccuccaccucgucuuccaccccaccucccucuucgccauccaggucaacaucuccgucaacacccucggcugccuccagcucaccaacaucaagcucaacgacgacaacugccaggucuucaucaaguuccucuccgagcucacccgcggccccacccuccucaacuucacccucaaccacaucgagaccaccuggaagugccucguccgcgucuuccaguuccucuggcccaagcccgucgaguaccucaacaucuacaaccucaccaucaucgaguccauccgcgaggaggacuucaccuacuccaagaccacccucaaggcccucaccaucgagcacaucaccaaccaggucuuccucuucucccagaccgcccucuacaccgucuucuccgagaugaacaucaugaugcucaccaucuccgacacccccuucauccacaugcucugcccccacgcccccuccaccuucaaguuccucaacuucacccagaacgucuucaccgacuccaucuucgagaagugcuccacccucgucaagcucgagacccucauccuccagaagaacggccucaaggaccucuucaaggucggccucaugaccaaggacaugcccucccucgagauccucgacgucuccuggaacucccucgaguccggccgccacaaggagaacugcaccugggucgaguccaucgucguccucaaccucuccuccaacaugcucaccgacuccgucuuccgcugccuccccccccgcaucaagguccucgaccuccacuccaacaagaucaaguccauccccaagcaggucgucaagcucgaggcccuccaggagcucaacgucgccuucaacucccucaccgaccuccccggcugcggcuccuucuccucccucuccguccucaucaucgaccacaacuccgucucccaccccuccgccgacuucuuccaguccugccagaagaugcgcuccaucaaggccggcgacaaccccuuccagugcaccugcgagcuccgcgaguucgucaagaacaucgaccaggucuccuccgagguccucgagggcuggcccgacuccuacaagugcgacuaccccgaguccuaccgcggcuccccccucaaggacuuccacauguccgagcucuccugcaacaucacccuccucaucgucaccaucggcgccaccaugcucguccucgccgucaccgucaccucccucugcaucuaccucgaccuccccugguaccuccgcauggucugccaguggacccagacccgccgccgcgcccgcaacaucccccucgaggagcuccagcgcaaccuccaguuccacgccuucaucuccuacuccgagcacgacuccgccugggucaaguccgagcucguccccuaccucgagaaggaggacauccagaucugccuccacgagcgcaacuucguccccggcaaguccaucgucgagaacaucaucaacugcaucgagaaguccuacaaguccaucuucguccucucccccaacuucguccaguccgaguggugccacuacgagcucuacuucgcccaccacaaccucuuccacgagggcuccaacaaccucauccucauccuccucgagcccaucccccagaacuccauccccaacaaguaccacaagcucaaggcccucaugaugcagcgcaccuaccuccaguggcccaaggagaaguccaagcgcggccucuucugggccaacauccgcgccgccuucaacaugaagcucacccucgucaccgagaacaacgacgucaaguccuga

SEQ ID NO: 9722 - RNA, 2391 nt, Artificial Sequence
  derived and/or modified sequence opt3 from TLR6__Homo_sapiens__AAY88755
augaccaaggacaaagagcccaucgucaagagcuuccacuuugugugccugaugauuauaaucguuggcacaaggauucaguucuccgaugggaacgaauuugccguggacaaaucuaagagaggacucauccauguaccuaaagaucuuccacugaagacuaagguguuggacaugucacaaaauuacauugcugaguuacaggucagugauaugagcuuccuguccgaacuaacggugcuccggcugucucacaaccgcauccagcuucuggacuugucgguuuuuaaauucaaucaggaucucgaguaucuggaccugucacauaaccaacuccagaagauaagcugucacccgaucgugaguuuucgacauuuagaucuguccuucaaugacuuuaaagcacuucccauuugcaaggaguucgguaacuugucucagcugaauuuucuaggccucagcgccaugaaacugcagaaacuugaucuguugccuaucgcgcaccuccaccuguccuacauuuuacuggaccuccguaacuauuacaucaaggagaaugagaccgaaucacuucaaauacugaacgcuaagacauugcaucuagucuuccacccaacuucccuguuugccauucaggugaauaucagcguaaacacccucgggugucugcagcuuacaaauauuaagcugaacgaugacaauugccagguuuucaucaaauucuugucugagcucaccagaggacccacucuguuaaacuuuacacugaaccauaucgaaaccacguggaagugucuagugagggucuuccaauuucucuggccuaaaccaguggaguaucugaauauuuacaaccuuacuauaaucgaguccauucgggaagaggacuucaccuauucaaagacaacuuugaaagcacugaccaucgaacacauaacaaaucagguguuucucuucagccagaccgcccuguacacggucuuuagugagaugaacauuaugaugcuuacuaucucugauacacccuucauccacaugcugugcccucaugcuccauccaccuuuaaguucuugaauuuuacucaaaacguuuucacagacagcauuuuugaaaaguguucgacccucgugaaacuggagacguuaauccugcagaagaauggccuaaaagaucucuucaagguaggucugaugaccaaagacaugccgucucuugagauuuuggauguguccuggaacucacuggaaagugggcgccacaaggagaauugcacaugggucgaaagcauagugguucucaaccuguccucuaauauguuaacugacagcguguucagaugucugcccccuaggaucaagguccuugauuugcauucaaacaaaauuaagaguaucccaaaacaggugguaaagcucgaggcacugcaggaacuaaauguugccuuuaacucccugaccgaccuccccggaugcggcagcuucucuucacugagugugcuuaucauugaucacaauagcgucucccauccuucugcugacuuuuuccaaucgugucagaaaaugcggagcauaaaggccggcgauaacccauuucagugcacaugcgaguugcgcgaguucgugaagaacaucgaccaggucuccucagaagugcuggagggguggcccgacaguuacaaaugugauuauccggaaucuuaccgaggaagcccuuuaaaggacuuucacauguccgagcucucaugcaauauuacucugcuuaucguuaccauuggugcgacaaugcugguguuggcaguaaccgucacuagccucuguaucuaucuggaucuacccugguaccugagaauggugugccaauggacgcagacaaggcggcgugcccgcaacauaccacucgaagaacugcagagaaaucuucaguuccacgcuuuuaucucuuauuccgagcaugacagugccuggguuaaaagcgaauuggugccuuaccuggagaaggaagauauucaaaucuguuuacacgagaggaacuucguccccggcaaaucuauuguggagaauaucauaaacugcauugaaaaguccuauaagucaaucuuuguacucaguccaaauuucgugcagagcgaguggugucauuacgaacuguacuuugcacaccacaaccuuuuccaugaggggucgaauaaccugauucuaauccuccuggaacccauaccucagaauaguaucccaaacaaauaucacaaguugaaagcucugaugaugcagcggaccuacuuacaauggccgaaggagaaaucuaagcgaggacucuucugggccaauauucgcgcggccuuuaacaugaaacugacucuuguuaccgagaauaacgacgucaagagcuga

SEQ ID NO: 9723 - RNA, 2391 nt, Artificial Sequence
  derived and/or modified sequence opt4 from TLR6__Homo_sapiens__AAY88755
augaccaaggacaaggagcccaucgugaagagcuuccacuucgugugccugaugaucaucaucgugggcaccagaauccaguucagcgacggcaacgaguucgccguggacaagagcaagagaggccugauccacgugcccaaggaccugccccugaagaccaaggugcuggacaugagccagaacuacaucgccgagcugcaggugagcgacaugagcuuccugagcgagcugaccgugcugagacugagccacaacagaauccagcugcuggaccugagcguguucaaguucaaccaggaccuggaguaccuggaccugagccacaaccagcugcagaagaucagcugccaccccaucgugagcuucagacaccuggaccugagcuucaacgacuucaaggcccugcccaucugcaaggaguucggcaaccugagccagcugaacuuccugggccugagcgccaugaagcugcagaagcuggaccugcugcccaucgcccaccugcaccugagcuacauccugcuggaccugagaaacuacuacaucaaggagaacgagaccgagagccugcagauccugaacgccaagacccugcaccugguguuccaccccaccagccuguucgccauccaggugaacaucagcgugaacacccugggcugccugcagcugaccaacaucaagcugaacgacgacaacugccagguguucaucaaguuccugagcgagcugaccagaggccccacccugcugaacuucacccugaaccacaucgagaccaccuggaagugccuggugagaguguuccaguuccuguggcccaagcccguggaguaccugaacaucuacaaccugaccaucaucgagagcaucagagaggaggacuucaccuacagcaagaccacccugaaggcccugaccaucgagcacaucaccaaccagguguuccuguucagccagaccgcccuguacaccguguucagcgagaugaacaucaugaugcugaccaucagcgacacccccuucauccacaugcugugcccccacgcccccagcaccuucaaguuccugaacuucacccagaacguguucaccgacagcaucuucgagaagugcagcacccuggugaagcuggagacccugauccugcagaagaacggccugaaggaccuguucaaggugggccugaugaccaaggacaugcccagccuggagauccuggacgugagcuggaacagccuggagagcggcagacacaaggagaacugcaccuggguggagagcaucguggugcugaaccugagcagcaacaugcugaccgacagcguguucagaugccugccccccagaaucaaggugcuggaccugcacagcaacaagaucaagagcauccccaagcagguggugaagcuggaggcccugcaggagcugaacguggccuucaacagccugaccgaccugcccggcugcggcagcuucagcagccugagcgugcugaucaucgaccacaacagcgugagccaccccagcgccgacuucuuccagagcugccagaagaugagaagcaucaaggccggcgacaaccccuuccagugcaccugcgagcugagagaguucgugaagaacaucgaccaggugagcagcgaggugcuggagggcuggcccgacagcuacaagugcgacuaccccgagagcuacagaggcagcccccugaaggacuuccacaugagcgagcugagcugcaacaucacccugcugaucgugaccaucggcgccaccaugcuggugcuggccgugaccgugaccagccugugcaucuaccuggaccugcccugguaccugagaauggugugccaguggacccagaccagaagaagagccagaaacaucccccuggaggagcugcagagaaaccugcaguuccacgccuucaucagcuacagcgagcacgacagcgccugggugaagagcgagcuggugcccuaccuggagaaggaggacauccagaucugccugcacgagagaaacuucgugcccggcaagagcaucguggagaacaucaucaacugcaucgagaagagcuacaagagcaucuucgugcugagccccaacuucgugcagagcgaguggugccacuacgagcuguacuucgcccaccacaaccuguuccacgagggcagcaacaaccugauccugauccugcuggagcccaucccccagaacagcauccccaacaaguaccacaagcugaaggcccugaugaugcagagaaccuaccugcaguggcccaaggagaagagcaagagaggccuguucugggccaacaucagagccgccuucaacaugaagcugacccuggugaccgagaacaacgacgugaagagcuga

SEQ ID NO: 9724 - RNA, 2391 nt, Artificial Sequence
  derived and/or modified sequence opt5 from TLR6__Homo_sapiens__AAY88755
augaccaaggacaaagagcccaucgugaaguccuuccacuuugugugccugaugauuaucauuguuggcacaagaauccaguucuccgaugggaacgaauuugccguggacaaaucuaagcggggacucauucaugugccuaaagaucugccgcuuaagacgaagguccuggacaugagccaaaauuacaucgcugagcuccagguguccgauaugucuuuccugagcgaacuuaccguucugcgccucucccacaacagaauccagcugcuggaccucucuguguuuaaauucaaucaggaucuggaguaucuugaccugagccauaaccaacuccagaagauuuccugucaccccaucgucagcuuucggcaucuggaucuuucuuucaaugacuuuaaagcccugccuauuugcaaggaguucggcaaccucucccagcugaauuuucuggggcucagcgcgaugaaacugcagaagcucgaucugcuccccaucgcucaucugcaccuuucuuacauucugcucgaccugcgcaacuauuacaucaaggagaaugagacagaaucccugcaaauucucaacgccaaaacccugcaccuuguguuccacccuacaagccuguuugccauccagguuaauaucucugugaacacccucggaugucugcagcuuacaaauauuaagcugaacgaugacaauugccaggucuucaucaaauuccucuccgagcugaccagaggccccacgcugcucaacuuuacccugaaccauauugaaacaaccuggaagugucuugugcggguguuccaauuucuguggccuaaaccggucgaguaucucaauaucuacaaccugacaauuaucgagagcauccgcgaagaggacuucaccuauuccaagacgacacugaaagcucuuaccauugaacacaucacaaaucagguuuuucucuucucucagaccgcccuguacaccguguuuagcgagaugaacauuaugaugcugacaaucuccgauacgcccuucauucacaugcucugcccucaugcucccagcaccuuuaaguuccugaauuuuacacaaaacguguucaccgacucuaucuuugaaaaguguuccacacuugucaaacuggagacccucauccugcagaagaaugggcugaaagaucuuuucaaggugggacucaugacgaaagacaugccuagccuggagauucuggauguuucuuggaacagccucgaauccggcagacacaaggagaauugcacauggguggaaucuaucgucgugcugaaccuuagcuccaauaugcugaccgacagcguuuuccggugucuucccccgcgcauuaaggugcuggaucugcauucuaacaaaaucaaguccauuccuaaacaggucgugaaacuugaggcccuccaggaacugaaugucgcguuuaacagccugaccgaccuccccggcugcgggucuuucuccagccuguccgugcuuaucauugaucacaauucuguuagccauccuuccgccgacuuuuuccaaucuugucagaagaugagaagcaucaaggcuggagauaaccccuuucagugcacaugcgagcugcgggaguucgugaagaacaucgaccaggucuccagcgaagugcucgagggcuggcccgacucuuacaaaugugauuauccugaauccuaccgcgggagcccgcugaaggacuuucacaugucugagcuguccugcaauauuacccuucucaucguuacaauuggagccacgaugcuggugcuggcugucaccgugacaagccucuguaucuaucuggaucuucccugguaccugagaauggugugccaauggacccagacacggcgcagagcccggaacauuccucucgaagaacugcagagaaaucugcaguuccacgcguuuaucucuuauagcgagcaugacuccgccuggguuaaaagcgaacuuguccccuaccuggagaaggaagauauccaaauuugucuccacgagcgcaacuucgugccuggcaaaucuaucguggagaauauuaucaacugcauugaaaaguccuauaagagcaucuuuguccugucccccaauuucgugcagucugaguggugucauuacgaacucuacuuugcucaccacaaccuguuccaugaggggagcaauaaccuuauccugauucuccuggaaccgaucccucagaauagcauucccaacaaauaucacaagcugaaagcccuuaugaugcagcggaccuaccugcaauggccuaaggagaaaucuaagagaggacucuucugggcuaauauccgcgccgccuuuaacaugaaacugacgcucguuaccgagaauaacgacgucaagagcuga

SEQ ID NO: 9725 - protein, 796 aa, Artificial Sequence [sequence omitted]

SEQ ID NO: 9726 - RNA, 2391 nt, Artificial Sequence
  TLR6__Homo_sapiens__AAY88758
augaccaaagacaaagaaccuauuguuaaaagcuuccauuuuguuugccuuaugaucauaauaguuggaaccagaauccaguucuccgacggaaaugaauuugcaguagacaagucaaaaagaggucuuauucauguuccaaaagaccuaccgcugaaaaccaaagucuuagauaugucucagaacuacaucgcugagcuucaggucucugacaugagcuuucuaucagaguugacaguuuugagacuuucccauaacagaauccagcuacuugauuuaaguguuuucaaguucaaccaggauuuagaauauuuggauuuaucucauaaucaguugcaaaagauauccugccauccuauugugaguuucaggcauuuagaucucucauucaaugauuucaaggcccugcccaucuguaaggaauuuggcaacuuaucacaacugaauuucuugggauugagugcuaugaagcugcaaaaauuagauuugcugccaauugcucacuugcaucuaaguuauauccuucuggauuuaagaaauuauuauauaaaagaaaaugagacagaaagucuacaaauucugaaugcaaaaacccuucaccuuguuuuucacccaacuaguuuauucgcuauccaagugaacauaucaguuaauacuuuagggugcuuacaacugacuaauauuaaauugaaugaugacaacugucaaguuuucauuaaauuuuuaucagaacucaccagagguccaaccuuacugaauuuuacccucaaccacauagaaacgacuuggaaaugccuggucagagucuuucaauuucuuuggcccaaaccuguggaauaucucaauauuuacaauuuaacaauaauugaaagcauucgugaagaagauuuuacuuauucuaaaacgacauugaaagcauugacaauagaacauaucacgaaccaaguuuuucuguuuucacagacagcuuuguacaccguguuuucugagaugaacauuaugauguuaaccauuucagauacaccuuuuauacacaugcuguguccucaugcaccaagcacauucaaguuuuugaacuuuacccagaacguuuucacagauaguauuuuugaaaaauguuccacguuaguuaaauuggagacacuuaucuuacaaaagaauggauuaaaagaccuuuucaaaguaggucucaugacgaaggauaugccuucuuuggaaauacuggauguuagcuggaauucuuuggaaucugguagacauaaggaaaacugcacuuggguugagaguauagugguguuaaauuugucuucaaauaugcuuacugacucuguuuucagauguuuaccucccaggaucaagguacuugaucuucacagcaauaaaauaaagagcauuccuaaacaagucguaaaacuggaagcuuugcaagaacucaauguugcuuucaauucuuuaacugaccuuccuggauguggcagcuuuagcagccuuucuguauugaucauugaucacaauucaguuucccacccaucggcugauuucuuccagagcugccagaagaugaggucaauaaaagcaggggacaauccauuccaauguaccugugagcuaagagaauuugucaaaaauauagaccaaguaucaagugaaguguuagagggcuggccugauucuuauaagugugacuacccagaaaguuauagaggaagcccacuaaaggacuuucacaugucugaauuauccugcaacauaacucugcugaucgucaccaucggugccaccaugcugguguuggcugugacugugaccucccucugcaucuacuuggaucugcccugguaucucaggauggugugccaguggacccagacucggcgcagggccaggaacauacccuuagaagaacuccaaagaaaccuccaguuucaugcuuuuauuucauauagugaacaugauucugccugggugaaaagugaauugguaccuuaccuagaaaaagaagauauacagauuugucuucaugagagaaacuuugucccuggcaagagcauuguggaaaauaucaucaacugcauugagaagaguuacaaguccaucuuuguuuugucucccaacuuuguccagagugaguggugccauuacgaacucuauuuugcccaucacaaucucuuucaugaaggaucuaauaacuuaauccucaucuuacuggaacccauucuacagaacagcauucccaacaaguaccacaagcugaaggcucucaugaugcagcggacuuauuugcaguggcccaaggagaaaagcaaacgugggcucuuuugggcuaacauuagagccgcuuuuaauaugaaauuaacacuagucacugaaaacaaugaugugaaaucuuaa

SEQ ID NO: 9727 - RNA, 2391 nt, Artificial Sequence
  derived and/or modified sequence opt1 from TLR6__Homo_sapiens__AAY88758
augaccaaggacaaggagcccaucgucaagagcuuccacuucgugugccugaugaucaucaucgugggcacccgcauccaguucuccgacgggaacgaguucgccguggacaagagcaagcggggccucauccacgucccgaaggaccugccccugaagacgaaggugcucgacaugucccagaacuacaucgccgagcuccaggugagcgacauguccuuccugagcgagcugaccguccugcgccugucccacaaccggauccagcuccuggaccugagcguguucaaguucaaccaggaccucgaguaccuggaccugucccacaaccagcuccagaagaucagcugccaccccaucguguccuuccgccaccuggaccugagcuucaacgacuucaaggcgcuccccaucugcaaggaguucgggaaccugucccagcugaacuuccucggccugagcgccaugaagcugcagaagcucgaccugcugccgaucgcccaccuccaccuguccuacauccugcucgaccugcggaacuacuacaucaaggagaacgagaccgagagccugcagauccucaacgccaagacccugcaccuggucuuccaccccacgucccucuucgccauccaggugaacaucagcgugaacacccuggggugccugcagcucaccaacaucaagcugaacgacgacaacugccaggucuucaucaaguuccuguccgagcucacccgcggccccacgcugcugaacuucacccucaaccacaucgagaccaccuggaagugccuggugcggguguuccaguuccuguggcccaagccggucgaguaccucaacaucuacaaccugacgaucaucgagagcauccgcgaggaggacuucaccuacagcaagaccacccugaaggcgcugacgaucgagcacaucaccaaccagguguuccucuucucccagaccgcccuguacaccguguucagcgagaugaacaucaugaugcugacgaucuccgacacccccuucauccacaugcucugcccccacgcccccagcaccuucaaguuccugaacuucacccagaacgucuucacggacuccaucuucgagaagugcagcacccuggugaagcucgagacccugauccugcagaagaacggccucaaggaccuguucaagguggggcugaugaccaaggacaugccgucccucgagauccuggacgucagcuggaacucccuggagagcggccggcacaaggagaacugcacguggguggaguccaucgugguccucaaccugagcuccaacaugcugaccgacagcguguuccgcugccucccgccccggaucaagguccuggaccugcacuccaacaagaucaagagcauccccaagcaggucgugaagcucgaggcccugcaggagcugaacguggcguucaacucccucaccgaccugcccgggugcggcagcuucuccagccugagcgugcucaucaucgaccacaacuccgugagccaccccuccgccgacuucuuccagagcugccagaagaugcgcuccaucaaggccggggacaaccccuuccagugcacgugcgagcugcgggaguucgucaagaacaucgaccaggugagcuccgaggugcuggagggcuggcccgacagcuacaagugcgacuacccggaguccuaccgcggcagcccccucaaggacuuccacauguccgagcugagcugcaacaucacccugcucaucgucaccaucggggccaccaugcuggugcuggccgugaccgucacgucccucugcaucuaccuggaccugcccugguaccuccggauggugugccaguggacccagacccgccggcgcgcgcggaacaucccccuggaggagcugcagcgcaaccuccaguuccacgccuucaucagcuacuccgagcacgacagcgccugggugaaguccgagcuggucccguaccuggagaaggaggacauccagaucugccuccacgagcggaacuucgugcccggcaagagcaucguggagaacaucaucaacugcaucgagaaguccuacaagagcaucuucguccugagccccaacuucgugcaguccgaguggugccacuacgagcuguacuucgcccaccacaaccucuuccacgaggggagcaacaaccugauccugauccuccuggagcccauccugcagaacuccaucccgaacaaguaccacaagcucaaggcccugaugaugcagcgcaccuaccugcaguggcccaaggagaaguccaagcgcggccucuucugggcgaacauccgggccgccuucaacaugaagcugacccuggugacggagaacaacgacgucaagagcuga

SEQ ID NO: 9728 - RNA, 2391 nt, Artificial Sequence
  derived and/or modified sequence opt2 from TLR6__Homo_sapiens__AAY88758
augaccaaggacaaggagcccaucgucaaguccuuccacuucgucugccucaugaucaucaucgucggcacccgcauccaguucuccgacggcaacgaguucgccgucgacaaguccaagcgcggccucauccacguccccaaggaccucccccucaagaccaagguccucgacaugucccagaacuacaucgccgagcuccaggucuccgacauguccuuccucuccgagcucaccguccuccgccucucccacaaccgcauccagcuccucgaccucuccgucuucaaguucaaccaggaccucgaguaccucgaccucucccacaaccagcuccagaagaucuccugccaccccaucgucuccuuccgccaccucgaccucuccuucaacgacuucaaggcccuccccaucugcaaggaguucggcaaccucucccagcucaacuuccucggccucuccgccaugaagcuccagaagcucgaccuccuccccaucgcccaccuccaccucuccuacauccuccucgaccuccgcaacuacuacaucaaggagaacgagaccgagucccuccagauccucaacgccaagacccuccaccucgucuuccaccccaccucccucuucgccauccaggucaacaucuccgucaacacccucggcugccuccagcucaccaacaucaagcucaacgacgacaacugccaggucuucaucaaguuccucuccgagcucacccgcggccccacccuccucaacuucacccucaaccacaucgagaccaccuggaagugccucguccgcgucuuccaguuccucuggcccaagcccgucgaguaccucaacaucuacaaccucaccaucaucgaguccauccgcgaggaggacuucaccuacuccaagaccacccucaaggcccucaccaucgagcacaucaccaaccaggucuuccucuucucccagaccgcccucuacaccgucuucuccgagaugaacaucaugaugcucaccaucuccgacacccccuucauccacaugcucugcccccacgcccccuccaccuucaaguuccucaacuucacccagaacgucuucaccgacuccaucuucgagaagugcuccacccucgucaagcucgagacccucauccuccagaagaacggccucaaggaccucuucaaggucggccucaugaccaaggacaugcccucccucgagauccucgacgucuccuggaacucccucgaguccggccgccacaaggagaacugcaccugggucgaguccaucgucguccucaaccucuccuccaacaugcucaccgacuccgucuuccgcugccuccccccccgcaucaagguccucgaccuccacuccaacaagaucaaguccauccccaagcaggucgucaagcucgaggcccuccaggagcucaacgucgccuucaacucccucaccgaccuccccggcugcggcuccuucuccucccucuccguccucaucaucgaccacaacuccgucucccaccccuccgccgacuucuuccaguccugccagaagaugcgcuccaucaaggccggcgacaaccccuuccagugcaccugcgagcuccgcgaguucgucaagaacaucgaccaggucuccuccgagguccucgagggcuggcccgacuccuacaagugcgacuaccccgaguccuaccgcggcuccccccucaaggacuuccacauguccgagcucuccugcaacaucacccuccucaucgucaccaucggcgccaccaugcucguccucgccgucaccgucaccucccucugcaucuaccucgaccuccccugguaccuccgcauggucugccaguggacccagacccgccgccgcgcccgcaacaucccccucgaggagcuccagcgcaaccuccaguuccacgccuucaucuccuacuccgagcacgacuccgccugggucaaguccgagcucguccccuaccucgagaaggaggacauccagaucugccuccacgagcgcaacuucguccccggcaaguccaucgucgagaacaucaucaacugcaucgagaaguccuacaaguccaucuucguccucucccccaacuucguccaguccgaguggugccacuacgagcucuacuucgcccaccacaaccucuuccacgagggcuccaacaaccucauccucauccuccucgagcccauccuccagaacuccauccccaacaaguaccacaagcucaaggcccucaugaugcagcgcaccuaccuccaguggcccaaggagaaguccaagcgcggccucuucugggccaacauccgcgccgccuucaacaugaagcucacccucgucaccgagaacaacgacgucaaguccuga

SEQ ID NO: 9729 - RNA, 2391 nt, Artificial Sequence
  derived and/or modified sequence opt3 from TLR6__Homo_sapiens__AAY88758
augaccaaggacaaagagcccaucgucaagagcuuccacuuugugugccugaugauuauaaucguuggcacaaggauucaguucuccgaugggaacgaauuugccguggacaaaucuaagagaggacucauccauguaccuaaagaucuuccacugaagacuaagguguuggacaugucacaaaauuacauugcugaguuacaggucagugauaugagcuuccuguccgaacuaacggugcuccggcugucucacaaccgcauccagcuucuggacuugucgguuuuuaaauucaaucaggaucucgaguaucuggaccugucacauaaccaacuccagaagauaagcugucacccgaucgugaguuuucgacauuuagaucuguccuucaaugacuuuaaagcacuucccauuugcaaggaguucgguaacuugucucagcugaauuuucuaggccucagcgccaugaaacugcagaaacuugaucuguugccuaucgcgcaccuccaccuguccuacauuuuacuggaccuccguaacuauuacaucaaggaaaaugagaccgaaucacuucaaauacugaacgcuaaaacauugcaucuagucuuccacccaacuucccuguuugccauucaggugaauaucagcguaaacacccucgggugucugcagcuuacaaauauuaagcugaacgaugacaauugccagguuuucaucaaauucuugucugagcucaccagaggacccacucuguuaaacuuuacacugaaccauaucgaaaccacguggaagugucuagugagggucuuccaauuucucuggccuaaaccaguggaguaucugaauauuuacaaccuuacuauaaucgaguccauucgggaagaggacuucaccuauucaaagacaacuuugaaagcacugaccaucgaacacauaacaaaucagguguuucucuucagccagaccgcccuguacacggucuuuagugagaugaacauuaugaugcuuacuaucucugauacacccuucauccacaugcugugcccucaugcuccauccaccuuuaaguucuugaauuuuacucaaaacguuuucacagacagcauuuuugaaaaguguucgacccucgugaaacuggagacguuaauccugcagaagaauggccuaaaagaucucuucaagguaggucugaugaccaaagacaugccgucucuugagauuuuggauguguccuggaacucacuggaaagugggcgccacaaggagaauugcacaugggucgaaagcauagugguucucaaccuguccucuaauauguuaacugacagcguguucagaugucugcccccuaggaucaagguccuugauuugcauucaaacaaaauuaagaguaucccaaaacaggugguaaagcucgaggcacugcaggaacuaaauguugccuuuaacucccugaccgaccuccccggaugcggcagcuucucuucacugagugugcuuaucauugaucacaauagcgucucccauccuucugcugacuuuuuccaaucgugucagaaaaugcggagcauaaaggccggcgauaacccauuucagugcacaugcgaguugcgcgaguucgugaagaacaucgaccaggucuccucagaagugcuggagggguggcccgacaguuacaaaugugauuauccggaaucuuaccgaggaagcccuuuaaaggacuuucacauguccgagcucucaugcaauauuacucugcuuaucguuaccauuggugcgacaaugcugguguuggcaguaaccgucacuagccucuguaucuaucuggaucuacccugguaccugagaauggugugccaauggacgcagacaaggcggcgugcccgcaacauaccacucgaggaacugcagagaaaucuucaguuccacgcuuuuaucucuuauuccgagcaugacagugccuggguuaaaagcgaauuggugccuuaccuggagaaggaagauauucaaaucuguuuacacgagaggaacuucguccccggcaaaucuauuguggagaauaucauaaacugcauugaaaaguccuauaagucaaucuuuguacucaguccaaauuucgugcagagcgaguggugucauuacgaacuguacuuugcacaccacaaccuuuuccaugaggggucgaauaaccugauucuaauccuccuggaacccauauugcagaauaguaucccuaacaaauaucacaagcugaaggcuuuaaugaugcagcggaccuaccuccaauggccaaaggagaaaucuaagcgaggacuguucugggccaauauucgcgcggccuuuaacaugaaacuuacucugguuaccgagaauaacgacgucaagagcuga

SEQ ID NO: 9730 - RNA, 2391 nt, Artificial Sequence
  derived and/or modified sequence opt4 from TLR6__Homo_sapiens__AAY88758
augaccaaggacaaggagcccaucgugaagagcuuccacuucgugugccugaugaucaucaucgugggcaccagaauccaguucagcgacggcaacgaguucgccguggacaagagcaagagaggccugauccacgugcccaaggaccugccccugaagaccaaggugcuggacaugagccagaacuacaucgccgagcugcaggugagcgacaugagcuuccugagcgagcugaccgugcugagacugagccacaacagaauccagcugcuggaccugagcguguucaaguucaaccaggaccuggaguaccuggaccugagccacaaccagcugcagaagaucagcugccaccccaucgugagcuucagacaccuggaccugagcuucaacgacuucaaggcccugcccaucugcaaggaguucggcaaccugagccagcugaacuuccugggccugagcgccaugaagcugcagaagcuggaccugcugcccaucgcccaccugcaccugagcuacauccugcuggaccugagaaacuacuacaucaaggagaacgagaccgagagccugcagauccugaacgccaagacccugcaccugguguuccaccccaccagccuguucgccauccaggugaacaucagcgugaacacccugggcugccugcagcugaccaacaucaagcugaacgacgacaacugccagguguucaucaaguuccugagcgagcugaccagaggccccacccugcugaacuucacccugaaccacaucgagaccaccuggaagugccuggugagaguguuccaguuccuguggcccaagcccguggaguaccugaacaucuacaaccugaccaucaucgagagcaucagagaggaggacuucaccuacagcaagaccacccugaaggcccugaccaucgagcacaucaccaaccagguguuccuguucagccagaccgcccuguacaccguguucagcgagaugaacaucaugaugcugaccaucagcgacacccccuucauccacaugcugugcccccacgcccccagcaccuucaaguuccugaacuucacccagaacguguucaccgacagcaucuucgagaagugcagcacccuggugaagcuggagacccugauccugcagaagaacggccugaaggaccuguucaaggugggccugaugaccaaggacaugcccagccuggagauccuggacgugagcuggaacagccuggagagcggcagacacaaggagaacugcaccuggguggagagcaucguggugcugaaccugagcagcaacaugcugaccgacagcguguucagaugccugccccccagaaucaaggugcuggaccugcacagcaacaagaucaagagcauccccaagcagguggugaagcuggaggcccugcaggagcugaacguggccuucaacagccugaccgaccugcccggcugcggcagcuucagcagccugagcgugcugaucaucgaccacaacagcgugagccaccccagcgccgacuucuuccagagcugccagaagaugagaagcaucaaggccggcgacaaccccuuccagugcaccugcgagcugagagaguucgugaagaacaucgaccaggugagcagcgaggugcuggagggcuggcccgacagcuacaagugcgacuaccccgagagcuacagaggcagcccccugaaggacuuccacaugagcgagcugagcugcaacaucacccugcugaucgugaccaucggcgccaccaugcuggugcuggccgugaccgugaccagccugugcaucuaccuggaccugcccugguaccugagaauggugugccaguggacccagaccagaagaagagccagaaacaucccccuggaggagcugcagagaaaccugcaguuccacgccuucaucagcuacagcgagcacgacagcgccugggugaagagcgagcuggugcccuaccuggagaaggaggacauccagaucugccugcacgagagaaacuucgugcccggcaagagcaucguggagaacaucaucaacugcaucgagaagagcuacaagagcaucuucgugcugagccccaacuucgugcagagcgaguggugccacuacgagcuguacuucgcccaccacaaccuguuccacgagggcagcaacaaccugauccugauccugcuggagcccauccugcagaacagcauccccaacaaguaccacaagcugaaggcccugaugaugcagagaaccuaccugcaguggcccaaggagaagagcaagagaggccuguucugggccaacaucagagccgccuucaacaugaagcugacccuggugaccgagaacaacgacgugaagagcuga

SEQ ID NO: 9731 - RNA, 2391 nt, Artificial Sequence
  derived and/or modified sequence opt5 from TLR6__Homo_sapiens__AAY88758
augaccaaggacaaagagcccaucgugaaguccuuccacuuugugugccugaugauuaucauuguuggcacaagaauccaguucuccgaugggaacgaauuugccguggacaaaucuaagcggggacucauucaugugccuaaagaucugccgcuuaagacgaagguccuggacaugagccaaaauuacaucgcugagcuccagguguccgauaugucuuuccugagcgaacuuaccguucugcgccucucccacaacagaauccagcugcuggaccucucuguguuuaaauucaaucaggaucuggaguaucuugaccugagccauaaccaacuccagaagauuuccugucaccccaucgucagcuuucggcaucuggaucuuucuuucaaugacuuuaaagcccugccuauuugcaaggaguucggcaaccucucccagcugaauuuucuggggcucagcgcgaugaaacugcagaagcucgaucugcuccccaucgcucaucugcaccuuucuuacauucugcucgaccugcgcaacuauuacaucaaggaaaaugagacagaaucccugcaaauucucaacgccaaaacccugcaccuuguguuccacccuacaagccuguuugccauccagguuaauaucucugugaacacccucggaugucugcagcuuacaaauauuaagcugaacgaugacaauugccaggucuucaucaaauuccucuccgagcugaccagaggccccacgcugcucaacuuuacccugaaccauauugaaacaaccuggaagugucuugugcggguguuccaauuucuguggccuaaaccggucgaguaucucaauaucuacaaccugacaauuaucgagagcauccgcgaagaggacuucaccuauuccaagacgacacugaaagcucuuaccauugaacacaucacaaaucagguuuuucucuucucucagaccgcccuguacaccguguuuagcgagaugaacauuaugaugcugacaaucuccgauacgcccuucauucacaugcucugcccucaugcucccagcaccuuuaaguuccugaauuuuacacaaaacguguucaccgacucuaucuuugaaaaguguuccacacuugucaaacuggagacccucauccugcagaagaaugggcugaaagaucuuuucaaggugggacucaugacgaaagacaugccuagccuggagauucuggauguuucuuggaacagccucgaauccggcagacacaaggagaauugcacauggguggaaucuaucgucgugcugaaccuuagcuccaauaugcugaccgacagcguuuuccggugucuucccccgcgcauuaaggugcuggaucugcauucuaacaaaaucaaguccauuccuaaacaggucgugaaacuugaggcccuccaggaacugaaugucgcguuuaacagccugaccgaccuccccggcugcgggucuuucuccagccuguccgugcuuaucauugaucacaauucuguuagccauccuuccgccgacuuuuuccaaucuugucagaagaugagaagcaucaaggcuggagauaaccccuuucagugcacaugcgagcugcgggaguucgugaagaacaucgaccaggucuccagcgaagugcucgagggcuggcccgacucuuacaaaugugauuauccugaauccuaccgcgggagcccgcugaaggacuuucacaugucugagcuguccugcaauauuacccuucucaucguuacaauuggagccacgaugcuggugcuggcugucaccgugacaagccucuguaucuaucuggaucuucccugguaccugagaauggugugccaauggacccagacacggcgcagagcccggaacauuccucucgaggaacugcagagaaaucugcaguuccacgcguuuaucucuuauagcgagcaugacuccgccuggguuaaaagcgaacuuguccccuaccuggagaaggaagauauccaaauuugucuccacgagcgcaacuucgugccuggcaaaucuaucguggagaauauuaucaacugcauugaaaaguccuauaagagcaucuuuguccugucccccaauuucgugcagucugaguggugucauuacgaacucuacuuugcucaccacaaccuguuccaugaggggagcaauaaccuuauccugauucuccuggaaccgauccugcagaauagcauuccuaacaaauaucacaaacuuaaggcccugaugaugcagcggaccuaccuccaauggcccaaggagaaaucuaagagaggacuguucugggcuaauauccgcgccgccuuuaacaugaaacucacgcugguuaccgagaauaacgacgucaagagcuga

SEQ ID NO: 9732 - protein, 796 aa, Artificial Sequence [sequence omitted]

SEQ ID NO: 9733 - RNA, 2391 nt, Artificial Sequence
  TLR6__Homo_sapiens__AAY88759
augaccaaagacaaagaaccuauuguuaaaagcuuccauuuuguuugccuuaugaucauaauaguuggaaccagaauccaguucuccgacggaaaugaauuugcaguagacaagucaaaaagaggucuuauucauguuccaaaagaccuaccgcugaaaaccaaagucuuagauaugucucagaacuacaucgcugagcuucaggucucugacaugagcuuucuaucagaguugacaguuuugagacuuucccauaacagaauccagcuacuugauuuaaguguuuucaaguucaaccaggauuuagaauauuuggauuuaucucauaaucaguugcaaaagauauccugccauccuauugugaguuucaggcauuuagaucucucauucaaugauuucaaggcccugcccaucuguaaggaauuuggcaacuuaucacaacugaauuucuugggauugagugcuaugaagcugcaaaaauuagauuugcugccaauugcucacuugcaucuaaguuauauccuucuggauuuaagaaauuauuauauaaaagaaaaugagacagaaagucuacaaauucugaaugcaaaaacccuucaccuuguuuuucacccaacuaguuuauucgcuauccaagugaacauaucaguuaauacuuuagggugcuuacaacugacuaauauuaaauugaaugaugacaacugucaaguuuucauuaaauuuuuaucagaacucaccagagguccaaccuuacugaauuuuacccucaaccacauagaaacgacuuggaaaugccuggucagagucuuucaauuucuuuggcccaaaccuguggaauaucucaauauuuacaauuuaacaauaauugaaagcauucgugaagaagauuuuacuuauucuaaaacgacauugaaagcauugacaauagaacauaucacgaaccaaguuuuucuguuuucacagacagcuuuguacaccguguuuucugagaugaacauuaugauguuaaccauuucagauacaccuuuuauacacaugcuguguccucaugcaccaagcacauucaaguuuuugaacuuuacccagaacguuuucacagauaguauuuuugaaaaauguuccacguuaguuaaauuggagacacuuaucuuacaaaagaauggauuaaaagaccuuuucaaaguaggucucaugacgaaggauaugccuucuuuggaaauacuggauguuagcuggaauucuuuggaaucugguagacauaaagaaaacugcacuuggguugagaguauagugguguuaaauuugucuucaaauaugcuuacugacucuguuuucagauguuuaccucccaggaucaagguacuugaucuucacagcaauaaaauaaagagcguuccuaaacaagucguaaaacuggaagcuuugcaagaacucaauguugcuuucaauucuuuaacugaccuuccuggauguggcagcuuuagcagccuuucuguauugaucauugaucacaauucaguuucccacccaucggcugauuucuuccagagcugccagaagaugaggucaauaaaagcaggggacaauccauuccaauguaccugugagcuaagagaauuugucaaaaauauagaccaaguaucaagugaaguguuagagggcuggccugauucuuauaagugugacuacccagaaaguuauagaggaagcccacuaaaggacuuucacaugucugaauuauccugcaacauaacucugcugaucgucaccaucggugccaccaugcugguguuggcugugacugugaccucccucugcaucuacuuggaucugcccugguaucucaggauggugugccaguggacccagacucggcgcagggccaggaacauacccuuagaagaacuccaaagaaaccuccaguuucaugcuuuuauuucauauagugaacaugauucugccugggugaaaagugaauugguaccuuaccuagaaaaagaagauauacagauuugucuucaugagagaaacuuugucccuggcaagagcauuguggaaaauaucaucaacugcauugagaagaguuacaaguccaucuuuguuuugucucccaacuuuguccagagugaguggugccauuacgaacucuauuuugcccaucacaaucucuuucaugaaggaucuaauaacuuaauccucaucuuacuggaacccauuccacagaacagcauucccaacaaguaccacaagcugaaggcucucaugaugcagcggacuuauuugcaguggcccaaggagaaaagcaaacgugggcucuuuugggcuaacauuagagccgcuuuuaauaugaaauuaacacuagucacugaaaacaaugaugugaaaucuuaa

SEQ ID NO: 9734 - RNA, 2391 nt, Artificial Sequence
  derived and/or modified sequence opt1 from TLR6__Homo_sapiens__AAY88759
augaccaaggacaaggagcccaucgucaagagcuuccacuucgugugccugaugaucaucaucgugggcacccgcauccaguucagcgacgggaacgaguucgccguggacaagagcaagcggggccucauccacgucccgaaggaccugccccugaagacgaaggugcucgacaugucccagaacuacaucgccgagcuccaggugagcgacauguccuuccugagcgagcugaccguccugcgccugucccacaaccggauccagcuccuggaccugagcguguucaaguucaaccaggaccucgaguaccuggaccugucccacaaccagcuccagaagaucagcugccaccccaucguguccuuccgccaccuggaccugagcuucaacgacuucaaggcgcuccccaucugcaaggaguucgggaaccugucccagcugaacuuccucggccugagcgccaugaagcugcagaagcucgaccugcugccgaucgcccaccuccaccuguccuacauccugcucgaccugcggaacuacuacaucaaggagaacgagaccgagagccugcagauccucaacgccaagacccugcaccuggucuuccaccccacgucccucuucgccauccaggugaacaucagcgugaacacccuggggugccugcagcucaccaacaucaagcugaacgacgacaacugccaggucuucaucaaguuccuguccgagcucacccgcggccccacgcugcugaacuucacccucaaccacaucgagaccaccuggaagugccuggugcggguguuccaguuccuguggcccaagccggucgaguaccucaacaucuacaaccugacgaucaucgagagcauccgcgaggaggacuucaccuacagcaagaccacccugaaggcgcugacgaucgagcacaucaccaaccagguguuccucuucucccagaccgcccuguacaccguguucagcgagaugaacaucaugaugcugacgaucuccgacacccccuucauccacaugcucugcccccacgcccccagcaccuucaaguuccugaacuucacccagaacgucuucacggacuccaucuucgagaagugcagcacccuggugaagcucgagacccugauccugcagaagaacggccucaaggaccuguucaagguggggcugaugaccaaggacaugccgucccucgagauccuggacgucagcuggaacucccuggagagcggccggcacaaggagaacugcacguggguggaguccaucgugguccucaaccugagcuccaacaugcugaccgacagcguguuccgcugccucccgccccggaucaagguccuggaccugcacuccaacaagaucaagagcgugcccaagcaggucgugaagcucgaggcccugcaggagcugaacguggcguucaacucccucaccgaccugcccgggugcggcagcuucuccagccugagcgugcucaucaucgaccacaacuccgucagccaccccuccgccgacuucuuccagagcugccagaagaugcgcuccaucaaggccggggacaaccccuuccagugcacgugcgagcugcgggaguucgugaagaacaucgaccaggugagcuccgagguccuggagggcuggcccgacagcuacaagugcgacuacccggaguccuaccgcggcagcccccucaaggacuuccacauguccgagcugagcugcaacaucacccugcucaucgugaccaucggggccaccaugcuggugcuggccgucaccgugacgucccucugcaucuaccuggaccugcccugguaccuccggauggugugccaguggacccagacccgccggcgcgcgcggaacaucccccuggaggagcugcagcgcaaccuccaguuccacgccuucaucagcuacuccgagcacgacagcgccugggucaaguccgagcuggugccguaccuggagaaggaggacauccagaucugccuccacgagcggaacuucgugcccggcaagagcaucgucgagaacaucaucaacugcaucgagaaguccuacaagagcaucuucgugcugagccccaacuucgugcaguccgaguggugccacuacgagcuguacuucgcccaccacaaccucuuccacgaggggagcaacaaccugauccugauccuccuggagcccaucccgcagaacuccauccccaacaaguaccacaagcugaaggcccucaugaugcagcgcaccuaccugcaguggcccaaggagaaguccaagcgcggccuguucugggcgaacauccgggccgccuucaacaugaagcucacccuggucacggagaacaacgacgugaaguccuga

SEQ ID NO: 9735 - RNA, 2391 nt, Artificial Sequence
  derived and/or modified sequence opt2 from TLR6__Homo_sapiens__AAY88759
augaccaaggacaaggagcccaucgucaaguccuuccacuucgucugccucaugaucaucaucgucggcacccgcauccaguucuccgacggcaacgaguucgccgucgacaaguccaagcgcggccucauccacguccccaaggaccucccccucaagaccaagguccucgacaugucccagaacuacaucgccgagcuccaggucuccgacauguccuuccucuccgagcucaccguccuccgccucucccacaaccgcauccagcuccucgaccucuccgucuucaaguucaaccaggaccucgaguaccucgaccucucccacaaccagcuccagaagaucuccugccaccccaucgucuccuuccgccaccucgaccucuccuucaacgacuucaaggcccuccccaucugcaaggaguucggcaaccucucccagcucaacuuccucggccucuccgccaugaagcuccagaagcucgaccuccuccccaucgcccaccuccaccucuccuacauccuccucgaccuccgcaacuacuacaucaaggagaacgagaccgagucccuccagauccucaacgccaagacccuccaccucgucuuccaccccaccucccucuucgccauccaggucaacaucuccgucaacacccucggcugccuccagcucaccaacaucaagcucaacgacgacaacugccaggucuucaucaaguuccucuccgagcucacccgcggccccacccuccucaacuucacccucaaccacaucgagaccaccuggaagugccucguccgcgucuuccaguuccucuggcccaagcccgucgaguaccucaacaucuacaaccucaccaucaucgaguccauccgcgaggaggacuucaccuacuccaagaccacccucaaggcccucaccaucgagcacaucaccaaccaggucuuccucuucucccagaccgcccucuacaccgucuucuccgagaugaacaucaugaugcucaccaucuccgacacccccuucauccacaugcucugcccccacgcccccuccaccuucaaguuccucaacuucacccagaacgucuucaccgacuccaucuucgagaagugcuccacccucgucaagcucgagacccucauccuccagaagaacggccucaaggaccucuucaaggucggccucaugaccaaggacaugcccucccucgagauccucgacgucuccuggaacucccucgaguccggccgccacaaggagaacugcaccugggucgaguccaucgucguccucaaccucuccuccaacaugcucaccgacuccgucuuccgcugccuccccccccgcaucaagguccucgaccuccacuccaacaagaucaaguccguccccaagcaggucgucaagcucgaggcccuccaggagcucaacgucgccuucaacucccucaccgaccuccccggcugcggcuccuucuccucccucuccguccucaucaucgaccacaacuccgucucccaccccuccgccgacuucuuccaguccugccagaagaugcgcuccaucaaggccggcgacaaccccuuccagugcaccugcgagcuccgcgaguucgucaagaacaucgaccaggucuccuccgagguccucgagggcuggcccgacuccuacaagugcgacuaccccgaguccuaccgcggcuccccccucaaggacuuccacauguccgagcucuccugcaacaucacccuccucaucgucaccaucggcgccaccaugcucguccucgccgucaccgucaccucccucugcaucuaccucgaccuccccugguaccuccgcauggucugccaguggacccagacccgccgccgcgcccgcaacaucccccucgaggagcuccagcgcaaccuccaguuccacgccuucaucuccuacuccgagcacgacuccgccugggucaaguccgagcucguccccuaccucgagaaggaggacauccagaucugccuccacgagcgcaacuucguccccggcaaguccaucgucgagaacaucaucaacugcaucgagaaguccuacaaguccaucuucguccucucccccaacuucguccaguccgaguggugccacuacgagcucuacuucgcccaccacaaccucuuccacgagggcuccaacaaccucauccucauccuccucgagcccaucccccagaacuccauccccaacaaguaccacaagcucaaggcccucaugaugcagcgcaccuaccuccaguggcccaaggagaaguccaagcgcggccucuucugggccaacauccgcgccgccuucaacaugaagcucacccucgucaccgagaacaacgacgucaaguccuga

SEQ ID NO: 9736 - RNA, 2391 nt, Artificial Sequence
  derived and/or modified sequence opt3 from TLR6__Homo_sapiens__AAY88759
augaccaaggacaaagagcccaucgucaagagcuuccacuuugugugccugaugauuauaaucgugggcacaaggauucaguucuccgaugggaacgaauuugccguggacaaaucuaagagaggacucauccauguaccuaaagaucuuccacugaagacuaagguguuggacaugucacaaaauuacauugcugaguuacaggucagugauaugagcuuccuguccgaacuaacggugcuccggcugucucacaaccgcauccagcuucuggacuugucgguuuuuaaauucaaucaggaucucgaguaucuggaccugucacauaaccaacuccagaagauaagcugucacccgaucgugaguuuucgacauuuagaucuguccuucaaugacuuuaaagcacuucccauuugcaaggaguucgguaacuugucucagcugaauuuucuaggccucagcgccaugaaacugcagaaacuugaucuguugccuaucgcgcaccuccaccuguccuacauuuuacuggaccuccguaacuauuacaucaaggagaaugagaccgaaucacuucaaauacugaacgcuaagacauugcaucuagucuuccacccaacuucccuguuugccauucaggugaauaucagcguaaacacccucgggugucugcagcuuacaaauauuaagcugaacgaugacaauugccagguuuucaucaaauucuugucugagcucaccagaggacccacucuguuaaacuuuacacugaaccauaucgaaaccacguggaagugucuagugagggucuuccaauuucucuggccuaaaccaguggaguaucugaauauuuacaaccuuacuauaaucgaguccauucgggaagaggacuucaccuauucaaagacaacuuugaaagcacugaccaucgaacacauaacaaaucagguguuucucuucagccagaccgcccuguacacggucuuuagugagaugaacauuaugaugcuuacuaucucugauacacccuucauccacaugcugugcccucaugcuccauccaccuuuaaguucuugaauuuuacucaaaacguuuucacagacagcauuuuugaaaaguguucgacccucgugaaacuggagacguuaauccugcagaagaauggccuaaaagaucucuucaagguaggucugaugaccaaagacaugccgucucuugagauuuuggauguguccuggaacucacuggaaagugggcgccacaaggagaauugcacaugggucgaaagcauagugguucucaaccuguccucuaauauguuaacugacagcguguucagaugucugcccccuaggaucaagguccuugauuugcauucaaacaaaauuaagagugugccaaaacagguaguuaagcucgaggcacugcaggaacuaaauguggccuuuaacucccugaccgaccuccccggaugcggcagcuucucuucacugaguguccuuaucaucgaucacaauagcgugucccauccuucugcugacuuuuuccaaucgugucagaaaaugcggagcauuaaggccggcgauaacccauuucagugcacaugcgaguugcgcgaguucgucaagaacauagaccagguguccucagaaguucuggagggguggcccgacaguuacaaaugugauuauccggaaucuuaccgaggaagcccuuuaaaggacuuucacauguccgagcucucaugcaauaucacucugcuuauugugaccaucggugcgacaaugcugguauuggcagucaccgugacuagccucuguauuuaucuggaucuacccugguaccugagaaugguuugccaauggacgcagacaaggcggcgugcccgcaacaucccacucgaagaacugcagagaaaucuucaguuccacgcuuuuauaucuuauuccgagcaugacagugccugggugaaaagcgaauuggucccuuaccuggagaaggaagauauccaaauuuguuuacacgagaggaacuucgugcccggcaaaucuaucguagagaauauuaucaacugcauagaaaaguccuauaagucaauuuuugugcucaguccaaauuucguucagagcgaguggugucauuacgaacuguacuuugcacaccacaaccuuuuccaugaggggucgaauaaccugauccuaauucuccuggaacccaucccucagaauaguauaccaaacaaauaucacaaguugaaagcucugaugaugcagcggaccuacuuacaauggccgaaggagaaaucuaagcgaggacucuucugggccaauauccgcgcggccuuuaacaugaaacugacucuugucaccgagaauaacgacguuaagagcuga

SEQ ID NO: 9737 - RNA, 2391 nt, Artificial Sequence
  derived and/or modified sequence opt4 from TLR6__Homo_sapiens__AAY88759
augaccaaggacaaggagcccaucgugaagagcuuccacuucgugugccugaugaucaucaucgugggcaccagaauccaguucagcgacggcaacgaguucgccguggacaagagcaagagaggccugauccacgugcccaaggaccugccccugaagaccaaggugcuggacaugagccagaacuacaucgccgagcugcaggugagcgacaugagcuuccugagcgagcugaccgugcugagacugagccacaacagaauccagcugcuggaccugagcguguucaaguucaaccaggaccuggaguaccuggaccugagccacaaccagcugcagaagaucagcugccaccccaucgugagcuucagacaccuggaccugagcuucaacgacuucaaggcccugcccaucugcaaggaguucggcaaccugagccagcugaacuuccugggccugagcgccaugaagcugcagaagcuggaccugcugcccaucgcccaccugcaccugagcuacauccugcuggaccugagaaacuacuacaucaaggagaacgagaccgagagccugcagauccugaacgccaagacccugcaccugguguuccaccccaccagccuguucgccauccaggugaacaucagcgugaacacccugggcugccugcagcugaccaacaucaagcugaacgacgacaacugccagguguucaucaaguuccugagcgagcugaccagaggccccacccugcugaacuucacccugaaccacaucgagaccaccuggaagugccuggugagaguguuccaguuccuguggcccaagcccguggaguaccugaacaucuacaaccugaccaucaucgagagcaucagagaggaggacuucaccuacagcaagaccacccugaaggcccugaccaucgagcacaucaccaaccagguguuccuguucagccagaccgcccuguacaccguguucagcgagaugaacaucaugaugcugaccaucagcgacacccccuucauccacaugcugugcccccacgcccccagcaccuucaaguuccugaacuucacccagaacguguucaccgacagcaucuucgagaagugcagcacccuggugaagcuggagacccugauccugcagaagaacggccugaaggaccuguucaaggugggccugaugaccaaggacaugcccagccuggagauccuggacgugagcuggaacagccuggagagcggcagacacaaggagaacugcaccuggguggagagcaucguggugcugaaccugagcagcaacaugcugaccgacagcguguucagaugccugccccccagaaucaaggugcuggaccugcacagcaacaagaucaagagcgugcccaagcagguggugaagcuggaggcccugcaggagcugaacguggccuucaacagccugaccgaccugcccggcugcggcagcuucagcagccugagcgugcugaucaucgaccacaacagcgugagccaccccagcgccgacuucuuccagagcugccagaagaugagaagcaucaaggccggcgacaaccccuuccagugcaccugcgagcugagagaguucgugaagaacaucgaccaggugagcagcgaggugcuggagggcuggcccgacagcuacaagugcgacuaccccgagagcuacagaggcagcccccugaaggacuuccacaugagcgagcugagcugcaacaucacccugcugaucgugaccaucggcgccaccaugcuggugcuggccgugaccgugaccagccugugcaucuaccuggaccugcccugguaccugagaauggugugccaguggacccagaccagaagaagagccagaaacaucccccuggaggagcugcagagaaaccugcaguuccacgccuucaucagcuacagcgagcacgacagcgccugggugaagagcgagcuggugcccuaccuggagaaggaggacauccagaucugccugcacgagagaaacuucgugcccggcaagagcaucguggagaacaucaucaacugcaucgagaagagcuacaagagcaucuucgugcugagccccaacuucgugcagagcgaguggugccacuacgagcuguacuucgcccaccacaaccuguuccacgagggcagcaacaaccugauccugauccugcuggagcccaucccccagaacagcauccccaacaaguaccacaagcugaaggcccugaugaugcagagaaccuaccugcaguggcccaaggagaagagcaagagaggccuguucugggccaacaucagagccgccuucaacaugaagcugacccuggugaccgagaacaacgacgugaagagcuga

SEQ ID NO: 9738 - RNA, 2391 nt, Artificial Sequence
  derived and/or modified sequence opt5 from TLR6__Homo_sapiens__AAY88759
augaccaaggacaaagagcccaucgugaaguccuuccacuuugucugccugaugauuaucauuguuggcacaagaauccaguucuccgaugggaacgaauuugccguggacaaaucuaagcggggacucauucaugugccuaaagaucugccgcuuaagacgaagguccuggacaugagccaaaauuacaucgcugagcuccagguguccgauaugucuuuccugagcgaacuuaccguucugcgccucucccacaacagaauccagcugcuggaccucucuguguuuaaauucaaucaggaucuggaguaucuugaccugagccauaaccaacuccagaagauuuccugucaccccaucgucagcuuucggcaucuggaucuuucuuucaaugacuuuaaagcccugccuauuugcaaggaguucggcaaccucucccagcugaauuuucuggggcucagcgcgaugaaacugcagaagcucgaucugcuccccaucgcucaucugcaccuuucuuacauucugcucgaccugcgcaacuauuacaucaaggagaaugagacagaaucccugcaaauucucaacgccaaaacccugcaccuuguguuccacccuacaagccuguuugccauccagguuaauaucucugugaacacccucggaugucugcagcuuacaaauauuaagcugaacgaugacaauugccaggucuucaucaaauuccucuccgagcugaccagaggccccacgcugcucaacuuuacccugaaccauauugaaacaaccuggaagugucuugugcggguguuccaauuucuguggccuaaaccggucgaguaucucaauaucuacaaccugacaauuaucgagagcauccgcgaagaggacuucaccuauuccaagacgacacugaaagcucuuaccauugaacacaucacaaaucagguuuuucucuucucucagaccgcccuguacaccguguuuagcgagaugaacauuaugaugcugacaaucuccgauacgcccuucauucacaugcucugcccucaugcucccagcaccuuuaaguuccugaauuuuacacaaaacguguucaccgacucuaucuuugaaaaguguuccacacuugucaaacuggagacccucauccugcagaagaaugggcugaaagaucuuuucaaggugggacucaugacgaaagacaugccuagccuggagauucuggauguuucuuggaacagccucgaauccggcagacacaaggagaauugcacauggguggaaucuaucgucgugcugaaccuuagcuccaauaugcugaccgacagcguuuuccggugucuucccccgcgcauuaaggugcuggaucugcauucuaacaaaaucaaguccgucccuaaacagguggucaaacuugaggcccuccaggaacugaauguggcguuuaacagccugaccgaccuccccggcugcgggucuuucuccagccuguccguucuuauuaucgaucacaauucugugagccauccuuccgccgacuuuuuccaaucuugucagaagaugagaagcauuaaggcuggagauaaccccuuucagugcacaugcgagcugcgggaguucgucaagaacaucgaccagguguccagcgaaguucucgagggcuggcccgacucuuacaaaugugauuauccugaauccuaccgcgggagcccgcugaaggacuuucacaugucugagcuguccugcaauaucacccuucucauugugacaaucggagccacgaugcugguccuggcugugaccgugacaagccucuguauuuaucuggaucuucccugguaccugagaaugguuugccaauggacccagacacggcgcagagcccggaacaucccucucgaagaacugcagagaaaucugcaguuccacgcguuuauuucuuauagcgagcaugacuccgccugggucaaaagcgaacuugugcccuaccuggagaaggaagauauccaaaucugucuccacgagcgcaacuucgugccuggcaaaucuauugucgagaauaucauuaacugcaucgaaaaguccuauaagagcauuuuugugcugucccccaauuucguucagucugaguggugucauuacgaacucuacuuugcucaccacaaccuguuccaugaggggagcaauaaccuuauccugauccuccuggaaccgauuccucagaauagcauccccaacaaauaucacaagcugaaagcccuuaugaugcagcggaccuaccugcaauggccuaaggagaaaucuaagagaggacucuucugggcuaauauucgcgccgccuuuaacaugaaacugacgcucgugaccgagaauaacgacgucaagagcuga

SEQ ID NO: 9739 - protein, 796 aa, Artificial Sequence [sequence omitted]

SEQ ID NO: 9740 - RNA, 2391 nt, Artificial Sequence
  TLR6__Homo_sapiens__AAY88760
augaccaaagacaaagaaccuauuguuaaaagcuuccauuuuguuugccuuaugaucauaauaguuggaaccagaauccaguucuccgacggaaaugaauuugcaguagacaagucaaaaagaggucuuauucauguuccaaaagaccuaccgcugaaaaccaaagucuuagauaugucucagaacuacaucgcugagcuucaggucucugacaugagcuuucuaucagaguugacaguuuugagacuuucccauaacagaauccagcuacuugauuuaaguguuuucaaguucaaccaggauuuagaauauuuggauuuaucucauaaucaguugcaaaagauauccugccauccuauugugaguuucaggcauuuagaucucucauucaaugauuucaaggcccugcccaucuguaaggaauuuggcaacuuaucacaacugaauuucuugggauugagugcuaugaagcugcaaaaauuagauuugcugccaauugcucacuugcaucuaaguuauauccuucuggauuuaagaaauuauuauauaaaagaaaaugagacagaaagucuacaaauucugaaugcaaaaacccuucaccuuguuuuucacccaacuaguuuauucgcuauccaagugaacauaucaguuaauacuuuagggugcuuacaacugacuaauauuaaauugaaugaugacaacugucaaguuuucauuaaauuuuuaucagaacucaccagagguucaaccuuacugaauuuuacccucaaccacauagaaacgacuuggaaaugccuggucagagucuuucaauuucuuuggcccaaaccuguggaauaucucaauauuuacaauuuaacaauaauugaaagcauucgugaagaagauuuuacuuauucuaaaacgacauugaaagcauugacaauagaacauaucacgaaccaaguuuuucuguuuucacagacagcuuuguacaccguguuuucugagaugaacauuaugauguuaaccauuucagauacaccuuuuauacacaugcuguguccucaugcaccaagcacauucaaguuuuugaacuuuacccagaacguuuucacagauaguauuuuugaaaaauguuccacguuaguuaaauuggagacacuuaucuuacaaaagaauggauuaaaagaccuuuucaaaguaggucucaugacgaaggauaugccuucuuuggaaauacuggauguuagcuggaauucuuuggaaucugguagacauaaagaaaacugcacuuggguugagaguauagugguguuaaauuugucuucaaauaugcuuacugacucuguuuucagauguuuaccucccaggaucaagguacuugaucuucacagcaauaaaauaaagagcauuccuaaacaagucguaaaacuggaagcuuugcaagaacucaauguugcuuucaauucuuuaacugaccuuccuggauguggcagcuuuagcagccuuucuguauugaucauugaucacaauucaguuucccacccaucggcugauuucuuccagagcugccagaagaugaggucaauaaaagcaggggacaauccauuccaauguaccugugagcuaagagaauuugucaaaaauauagaccaaguaucaagugaaguguuagagggcuggccugauucuuauaagugugacuacccagaaaguuauagaggaagcccacuaaaggacuuucacaugucugaauuauccugcaacauaacucugcugaucgucaccaucggugccaccaugcugguguuggcugugacugugaccucccucugcaucuacuuggaucugcccugguaucucaggauggugugccaguggacccagacucggcgcagggccaggaacauacccuuagaagaacuccaaagaaaccuccaguuucaugcuuuuauuucauauagugaacaugauucugccugggugaaaagugaauugguaccuuaccuagaaaaagaagauauacagauuugucuucaugagagaaacuuugucccuggcaagagcauuguggaaaauaucaucaacugcauugagaagaguuacaaguccaucuuuguuuugucucccaacuuuguccagagugaguggugccauuacgaacucuauuuugcccaucacaaucucuuucaugaaggaucuaauaacuuaauccucaucuuacuggaacccauuccacagaacagcauucccaacaaguaccacaagcugaaggcucucaugaugcagcggacuuauuugcaguggcccaaggagaaaagcaaacgugggcucuuuugggcuaacauuagagccgcuuuuaauaugaaauuaacacuagucacugaaaacaaugaugugaaaucuuaa

SEQ ID NO: 9741 - RNA, 2391 nt, Artificial Sequence
  derived and/or modified sequence opt1 from TLR6__Homo_sapiens__AAY88760
augaccaaggacaaggagcccaucgucaagagcuuccacuucgugugccugaugaucaucaucgugggcacccgcauccaguucuccgacgggaacgaguucgccguggacaagagcaagcggggccucauccacgucccgaaggaccugccccugaagacgaaggugcucgacaugucccagaacuacaucgccgagcuccaggugagcgacauguccuuccugagcgagcugaccguccugcgccugucccacaaccggauccagcuccuggaccugagcguguucaaguucaaccaggaccucgaguaccuggaccugucccacaaccagcuccagaagaucagcugccaccccaucguguccuuccgccaccuggaccugagcuucaacgacuucaaggcgcuccccaucugcaaggaguucgggaaccugucccagcugaacuuccucggccugagcgccaugaagcugcagaagcucgaccugcugccgaucgcccaccuccaccuguccuacauccugcucgaccugcggaacuacuacaucaaggagaacgagaccgagagccugcagauccucaacgccaagacccugcaccuggucuuccaccccacgucccucuucgccauccaggugaacaucagcgugaacacccuggggugccugcagcucaccaacaucaagcugaacgacgacaacugccaggucuucaucaaguuccuguccgagcucacccgcggcagcacgcugcugaacuucacccucaaccacaucgagaccaccuggaagugccuggugcggguguuccaguuccuguggcccaagcccgucgaguaccucaacaucuacaaccugacgaucaucgagagcauccgcgaggaggacuucaccuacuccaagaccacccugaaggcgcugacgaucgagcacaucaccaaccagguguuccucuucagccagaccgcccuguacaccguguucuccgagaugaacaucaugaugcugacgaucagcgacaccccguucauccacaugcucugcccccacgcccccuccaccuucaaguuccugaacuucacccagaacgucuucacggacagcaucuucgagaagugcuccacccuggugaagcucgagacccugauccugcagaagaacggccucaaggaccuguucaagguggggcugaugaccaaggacaugcccagccucgagauccuggacgucuccuggaacagccuggaguccggccggcacaaggagaacugcacguggguggagagcaucgugguccucaaccuguccagcaacaugcugaccgacuccguguuccgcugccucccgccccggaucaagguccuggaccugcacagcaacaagaucaaguccauccccaagcaggucgugaagcucgaggcccugcaggagcugaacguggcguucaacagccucaccgaccugcccgggugcggcuccuucagcagccuguccgugcucaucaucgaccacaacagcgugucccacccgagcgccgacuucuuccaguccugccagaagaugcgcagcaucaaggccggggacaaccccuuccagugcacgugcgagcugcgggaguucgucaagaacaucgaccagguguccagcgaggugcuggagggcuggcccgacuccuacaagugcgacuaccccgagagcuaccgcggcuccccgcucaaggacuuccacaugagcgagcuguccugcaacaucacccugcucaucgucaccaucggggccaccaugcuggugcuggccgugaccgucacgagccucugcaucuaccuggaccugcccugguaccuccggauggugugccaguggacccagacccgccggcgcgcgcggaacaucccccuggaggagcugcagcgcaaccuccaguuccacgccuucaucuccuacagcgagcacgacuccgccugggucaagagcgagcuggugcccuaccuggagaaggaggacauccagaucugccuccacgagcggaacuucgugccgggcaagagcaucguggagaacaucaucaacugcaucgagaaguccuacaagagcaucuucguccugucccccaacuucgugcagagcgaguggugccacuacgagcuguacuucgcccaccacaaccucuuccacgagggguccaacaaccugauccugauccuccuggagcccaucccccagaacagcaucccgaacaaguaccacaagcugaaggcccucaugaugcagcgcaccuaccugcaguggcccaaggagaaguccaagcgcggccuguucugggcgaacauccgggccgccuucaacaugaagcucacccuggugacggagaacaacgacgucaagagcuga

SEQ ID NO: 9742 - RNA, 2391 nt, Artificial Sequence
  derived and/or modified sequence opt2 from TLR6__Homo_sapiens__AAY88760
augaccaaggacaaggagcccaucgucaaguccuuccacuucgucugccucaugaucaucaucgucggcacccgcauccaguucuccgacggcaacgaguucgccgucgacaaguccaagcgcggccucauccacguccccaaggaccucccccucaagaccaagguccucgacaugucccagaacuacaucgccgagcuccaggucuccgacauguccuuccucuccgagcucaccguccuccgccucucccacaaccgcauccagcuccucgaccucuccgucuucaaguucaaccaggaccucgaguaccucgaccucucccacaaccagcuccagaagaucuccugccaccccaucgucuccuuccgccaccucgaccucuccuucaacgacuucaaggcccuccccaucugcaaggaguucggcaaccucucccagcucaacuuccucggccucuccgccaugaagcuccagaagcucgaccuccuccccaucgcccaccuccaccucuccuacauccuccucgaccuccgcaacuacuacaucaaggagaacgagaccgagucccuccagauccucaacgccaagacccuccaccucgucuuccaccccaccucccucuucgccauccaggucaacaucuccgucaacacccucggcugccuccagcucaccaacaucaagcucaacgacgacaacugccaggucuucaucaaguuccucuccgagcucacccgcggcuccacccuccucaacuucacccucaaccacaucgagaccaccuggaagugccucguccgcgucuuccaguuccucuggcccaagcccgucgaguaccucaacaucuacaaccucaccaucaucgaguccauccgcgaggaggacuucaccuacuccaagaccacccucaaggcccucaccaucgagcacaucaccaaccaggucuuccucuucucccagaccgcccucuacaccgucuucuccgagaugaacaucaugaugcucaccaucuccgacacccccuucauccacaugcucugcccccacgcccccuccaccuucaaguuccucaacuucacccagaacgucuucaccgacuccaucuucgagaagugcuccacccucgucaagcucgagacccucauccuccagaagaacggccucaaggaccucuucaaggucggccucaugaccaaggacaugcccucccucgagauccucgacgucuccuggaacucccucgaguccggccgccacaaggagaacugcaccugggucgaguccaucgucguccucaaccucuccuccaacaugcucaccgacuccgucuuccgcugccuccccccccgcaucaagguccucgaccuccacuccaacaagaucaaguccauccccaagcaggucgucaagcucgaggcccuccaggagcucaacgucgccuucaacucccucaccgaccuccccggcugcggcuccuucuccucccucuccguccucaucaucgaccacaacuccgucucccaccccuccgccgacuucuuccaguccugccagaagaugcgcuccaucaaggccggcgacaaccccuuccagugcaccugcgagcuccgcgaguucgucaagaacaucgaccaggucuccuccgagguccucgagggcuggcccgacuccuacaagugcgacuaccccgaguccuaccgcggcuccccccucaaggacuuccacauguccgagcucuccugcaacaucacccuccucaucgucaccaucggcgccaccaugcucguccucgccgucaccgucaccucccucugcaucuaccucgaccuccccugguaccuccgcauggucugccaguggacccagacccgccgccgcgcccgcaacaucccccucgaggagcuccagcgcaaccuccaguuccacgccuucaucuccuacuccgagcacgacuccgccugggucaaguccgagcucguccccuaccucgagaaggaggacauccagaucugccuccacgagcgcaacuucguccccggcaaguccaucgucgagaacaucaucaacugcaucgagaaguccuacaaguccaucuucguccucucccccaacuucguccaguccgaguggugccacuacgagcucuacuucgcccaccacaaccucuuccacgagggcuccaacaaccucauccucauccuccucgagcccaucccccagaacuccauccccaacaaguaccacaagcucaaggcccucaugaugcagcgcaccuaccuccaguggcccaaggagaaguccaagcgcggccucuucugggccaacauccgcgccgccuucaacaugaagcucacccucgucaccgagaacaacgacgucaaguccuga

SEQ ID NO: 9743 - RNA, 2391 nt, Artificial Sequence
  derived and/or modified sequence opt3 from TLR6__Homo_sapiens__AAY88760
augaccaaggacaaagagcccaucgucaagagcuuccacuuugugugccugaugauuauaaucguuggcacaaggauucaguucuccgaugggaacgaauuugccguggacaaaucuaagagaggacucauccauguaccuaaagaucuuccacugaagacuaagguguuggacaugucacaaaauuacauugcugaguuacaggucagugauaugagcuuccuguccgaacuaacggugcuccggcugucucacaaccgcauccagcuucuggacuugucgguuuuuaaauucaaucaggaucucgaguaucuggaccugucacauaaccaacuccagaagauaagcugucacccgaucgugaguuuucgacauuuagaucuguccuucaaugacuuuaaagcacuucccauuugcaaggaguucgguaacuugucucagcugaauuuucuaggccucagcgccaugaaacugcagaaacuugaucuguugccuaucgcgcaccuccaccuguccuacauuuuacuggaccuccguaacuauuacaucaaggagaaugagaccgaaucacuucaaauacugaacgcuaagacauugcaucuagucuuccacccaacuucucuguuugccauucaggugaauaucagcguaaacacccucgggugucugcagcuuacaaauauuaagcugaacgaugacaauugccagguuuucaucaaauucuugucugagcucaccagaggauccacucuguuaaacuuuacacugaaccauaucgaaaccacguggaagugucuagugagggucuuccaauuucucuggcccaaaccuguggaguaucugaauauuuacaaccuuacuauaaucgagucaauucgggaagaggacuucaccuauagcaagacaacuuugaaagcacugaccaucgaacacauaacaaaucagguguuucucuucagucagaccgcccuguacacggucuuuucugagaugaacauuaugaugcuuacuaucuccgauacaccauucauccacaugcugugcccccaugcuccuagcaccuuuaaguucuugaauuuuacucaaaacguuuucacagacucgauuuuugaaaaguguucuacccucgugaaacuggagacguuaauccugcagaagaauggccuaaaagaucucuucaagguaggucugaugaccaaagacaugccaucccuugagauuuuggaugugucauggaacagucuggaaagcgggcgccacaaggagaauugcacaugggucgaauccauagugguucucaaccugucuagcaauauguuaacugacucaguguucagaugucugccgcccaggaucaagguccuugauuugcauaguaacaaaauuaaguccaucccuaaacaggugguaaagcucgaggcacugcaggaacuaaauguugccuuuaacagccugaccgaccucccaggaugcggcucuuucucaagucugagcgugcuuaucauugaucacaauuccgucucucaucccucggcugacuuuuuccaaagcugucagaaaaugcgguccauaaaggccggcgauaacccuuuucagugcacaugcgaguugcgcgaguucgugaagaacaucgaccaggucucaagugaagugcuggagggguggccagacucuuacaaaugugauuaucccgaaagcuaccgaggauccccguuaaaggacuuucacaugucagagcucagcugcaauauuacucugcuuaucguuaccauuggugcgacaaugcugguguuggcaguaaccgucacuucucucuguaucuaucuggaucuaccuugguaccugagaauggugugccaauggacgcagacaaggcggcgugcccgcaacauaccccucgaagaacugcagagaaaucuucaguuccacgcuuuuaucuccuauagugagcaugacagcgccuggguuaaaucugaauuggugccauaccuggagaaggaagauauucaaaucuguuuacacgagaggaacuucgucccuggcaaauccauuguggagaauaucauaaacugcauugaaaagucauauaagaguaucuuuguacucagccccaauuucgugcagucggaguggugucauuacgaacuguacuuugcacaccacaaccuuuuccaugagggguccaauaaccugauucuaauccuccuggaaccaauaccccagaauaguaucccuaacaaauaucacaaguugaaagcucugaugaugcagcggaccuacuuacaauggccaaaggagaaaagcaagcgaggacucuucugggccaauauucgcgcggccuuuaacaugaaacugacucuuguuaccgagaauaacgacgucaagucauga

SEQ ID NO: 9744 - RNA, 2391 nt, Artificial Sequence
  derived and/or modified sequence opt4 from TLR6__Homo_sapiens__AAY88760
augaccaaggacaaggagcccaucgugaagagcuuccacuucgugugccugaugaucaucaucgugggcaccagaauccaguucagcgacggcaacgaguucgccguggacaagagcaagagaggccugauccacgugcccaaggaccugccccugaagaccaaggugcuggacaugagccagaacuacaucgccgagcugcaggugagcgacaugagcuuccugagcgagcugaccgugcugagacugagccacaacagaauccagcugcuggaccugagcguguucaaguucaaccaggaccuggaguaccuggaccugagccacaaccagcugcagaagaucagcugccaccccaucgugagcuucagacaccuggaccugagcuucaacgacuucaaggcccugcccaucugcaaggaguucggcaaccugagccagcugaacuuccugggccugagcgccaugaagcugcagaagcuggaccugcugcccaucgcccaccugcaccugagcuacauccugcuggaccugagaaacuacuacaucaaggagaacgagaccgagagccugcagauccugaacgccaagacccugcaccugguguuccaccccaccagccuguucgccauccaggugaacaucagcgugaacacccugggcugccugcagcugaccaacaucaagcugaacgacgacaacugccagguguucaucaaguuccugagcgagcugaccagaggcagcacccugcugaacuucacccugaaccacaucgagaccaccuggaagugccuggugagaguguuccaguuccuguggcccaagcccguggaguaccugaacaucuacaaccugaccaucaucgagagcaucagagaggaggacuucaccuacagcaagaccacccugaaggcccugaccaucgagcacaucaccaaccagguguuccuguucagccagaccgcccuguacaccguguucagcgagaugaacaucaugaugcugaccaucagcgacacccccuucauccacaugcugugcccccacgcccccagcaccuucaaguuccugaacuucacccagaacguguucaccgacagcaucuucgagaagugcagcacccuggugaagcuggagacccugauccugcagaagaacggccugaaggaccuguucaaggugggccugaugaccaaggacaugcccagccuggagauccuggacgugagcuggaacagccuggagagcggcagacacaaggagaacugcaccuggguggagagcaucguggugcugaaccugagcagcaacaugcugaccgacagcguguucagaugccugccccccagaaucaaggugcuggaccugcacagcaacaagaucaagagcauccccaagcagguggugaagcuggaggcccugcaggagcugaacguggccuucaacagccugaccgaccugcccggcugcggcagcuucagcagccugagcgugcugaucaucgaccacaacagcgugagccaccccagcgccgacuucuuccagagcugccagaagaugagaagcaucaaggccggcgacaaccccuuccagugcaccugcgagcugagagaguucgugaagaacaucgaccaggugagcagcgaggugcuggagggcuggcccgacagcuacaagugcgacuaccccgagagcuacagaggcagcccccugaaggacuuccacaugagcgagcugagcugcaacaucacccugcugaucgugaccaucggcgccaccaugcuggugcuggccgugaccgugaccagccugugcaucuaccuggaccugcccugguaccugagaauggugugccaguggacccagaccagaagaagagccagaaacaucccccuggaggagcugcagagaaaccugcaguuccacgccuucaucagcuacagcgagcacgacagcgccugggugaagagcgagcuggugcccuaccuggagaaggaggacauccagaucugccugcacgagagaaacuucgugcccggcaagagcaucguggagaacaucaucaacugcaucgagaagagcuacaagagcaucuucgugcugagccccaacuucgugcagagcgaguggugccacuacgagcuguacuucgcccaccacaaccuguuccacgagggcagcaacaaccugauccugauccugcuggagcccaucccccagaacagcauccccaacaaguaccacaagcugaaggcccugaugaugcagagaaccuaccugcaguggcccaaggagaagagcaagagaggccuguucugggccaacaucagagccgccuucaacaugaagcugacccuggugaccgagaacaacgacgugaagagcuga

SEQ ID NO: 9745 - RNA, 2391 nt, Artificial Sequence
  derived and/or modified sequence opt5 from TLR6__Homo_sapiens__AAY88760
augaccaaggacaaagagcccaucgugaagucuuuccacuuugucugccugaugauuaucauuguuggcacaagaauccaguucuccgaugggaacgaauuugccguggacaaaucuaagcggggacucauucaugugccuaaagaucugccgcuuaagacgaagguccuggacaugagccaaaauuacaucgcugagcuccagguguccgauaugucuuuccugagcgaacuuaccguucugcgccucucccacaacagaauccagcugcuggaccucucuguguuuaaauucaaucaggaucuggaguaucuugaccugagccauaaccaacuccagaagauuuccugucaccccaucgucagcuuucggcaucuggaucuuucuuucaaugacuuuaaagcccugccuauuugcaaggaguucggcaaccucucccagcugaauuuucuggggcucagcgcgaugaaacugcagaagcuggaucugcuccccaucgcucaccuucaccuuucuuacauucugcucgaccugcgcaacuauuacaucaaggagaaugagacagaaucccugcaaauucucaacgccaaaacccugcaucuuguguuccacccuacaagccuguuugccauccagguuaauaucucugugaacacccucggaugucugcagcuuacaaauauuaagcugaacgaugacaauugccaggucuucaucaaauuccucuccgagcugaccagaggcagcacgcugcucaacuuuacccugaaccauauugaaacaaccuggaagugucuugugcggguguuccaauuucuguggcccaaaccugucgaguaucucaauaucuacaaccugacaauuaucgaguccauccgcgaagaggacuucaccuauucuaagacgacacugaaagcucuuaccauugaacacaucacaaaucagguuuuucucuucagccagaccgcccuguacaccguguuuuccgagaugaacauuaugaugcugacaaucagcgauacgccguucauucacaugcucugcccccaugcuccuucuaccuuuaaguuccugaauuuuacacaaaacguguucaccgacuccaucuuugaaaaguguagcacacuugucaaacuggagacccucauccugcagaagaaugggcugaaagaucuuuucaaggugggacucaugacgaaagacaugcccucucuggagauucuggauguuagcuggaacucccucgaaucuggcagacacaaggagaauugcacauggguggaaagcaucgucgugcugaaccuuuccagcaauaugcugaccgacucuguuuuccggugucucccuccccgcauuaaggugcuggaucugcauuccaacaaaaucaagagcauuccgaaacaggucgugaaacuugaggcccuccaggaacugaaugucgcguuuaacucucugaccgaccucccuggcugcggguccuucagcucccugucugugcuuaucauugaucacaauagcguuucccaucccucugccgacuuuuuccaaagcugucagaagaugagauccaucaaggcuggagauaacccuuuucagugcacaugcgagcugcgggaguucgugaagaacaucgaccaggucagcucugaagugcucgagggcuggcccgacuccuacaaaugugauuaucccgaaagcuaccgcgggucuccucugaaggacuuucacauguccgagcugagcugcaauauuacccuucucaucguuacaauuggagccacgaugcuggugcuggcugucaccgugacaucucucuguaucuaucuggaucuuccgugguaccugagaauggugugccaauggacccagacacggcgcagagcccggaacauuccccucgaagaacugcagagaaaucugcaguuccacgcguuuaucagcuauuccgagcaugacagcgccuggguuaaaucugaacuugucccuuaccuggagaaggaagauauccaaauuugucuccacgagcgcaacuucgugcccggcaaauccaucguggagaauauuaucaacugcauugaaaagagcuauaaguccaucuuuguccugucuccuaauuucgugcagagcgaguggugucauuacgaacucuacuuugcucaccacaaccuguuccaugagggguccaauaaccuuauccugauucuccuggaacccaucccgcagaauagcauuccuaacaaauaucacaagcugaaagcccuuaugaugcagcggaccuaccugcaauggcccaaggagaaaagcaagagaggacucuucugggcuaauauccgcgccgccuuuaacaugaaacugacgcucguuaccgagaauaacgacgugaaguccuga

SEQ ID NO: 9746 - protein, 796 aa, Artificial Sequence [sequence omitted]

SEQ ID NO: 9747 - RNA, 2391 nt, Artificial Sequence
  TLR6__Homo_sapiens__AAY88761
augaccaaagacaaagaaccuauuguuaaaagcuuccauuuuguuugccuuaugaucauaauaguuggaaccagaauccaguucuccgacggaaaugaauuugcaguagacaagucaaaaagaggucuuauucauguuccaaaagaccuaccgcugaaaaccaaagucuuagauaugucucagaacuacaucgcugagcuucaggucucugacaugagcuuucuaucagaguugacaguuuugagacuuucccauaacagaauccagcuacuugauuuaaguguuuucaaguucaaccaggauuuagaauauuuggauuuaucucauaaucaguugcaaaagauauccugccauccuauugugaguuucaggcauuuagaucucucauucaaugauuucaaggcccugcccaucuguaaggaauuuggcaacuuaucacaacugaauuucuugggauugagugcuaugaagcugcaaaaauuagauuugcugccaauugcucacuugcaucuaaguuauauccuucuggauuuaagaaauuauuauauaaaagaaaaugagacagaaagucuacaaauucugaaugcaaaaacccuucaccuuguuuuucacccaacuaguuuauucgcuauccaagugaacauaucaguuaauacuuuagggugcuuacaacugacuaauauuaaauugaaugaugacaacugucaaguuuucauuaaauuuuuaucagaacucaccagagguccaaccuuacugaauuuuacccucaaccacauagaaacgacuuggaaaugccuggucagagucuuucaauuucuuuggcccaaaccuguggaauaucucaauauuuacaauuuaacaauaauugaaagcauucgugaagaagauuuuacuuauucuaaaacgacauugaaagcauugacaauagaacauaucacgaaccaaguuuuucuguuuucacagacagcuuuguacaccauguuuucugagaugaacauuaugauguuaaccauuucagauacaccuuuuauacacaugcuguguccucaugcaccaagcacauucaaguuuuugaacuuuacgcagaacguuuucacagauaguauuuuugaaaaauguuccacguuaguuaaauuggagacacuuaucuuacaaaagaauggauuaaaagaccuuuucaaaguaggucucaugacgaaggauaugccuucuuuggaaauacuggauguuagcuggaauucuuuggaaucugguagacauaaggaaaacugcacuuggguugagaguauagugguguuaaauuugucuucaaauaugcuuacugacucuguuuucagauguuuaccucccaggaucaagguacuugaucuucacagcaauaaaauaaagagcauuccuaaacaagucguaaaacuggaagcuuugcaagaacucaauguugcuuucaauucuuuaacugaccuuccuggauguggcagcuuuagcagccuuucuguauugaucauugaucacaauucaguuucccacccaucggcugauuucuuccagagcugccagaagaugaggucaauaaaagcaggggacaauccauuccaauguaccugugagcuaagagaauuugucaaaaauauagaccaaguaucaagugaaguguuagagggcuggccugauucuuauaagugugacuacccagaaaguuauagaggaagcccacuaaaggacuuucacaugucugaauuauccugcaacauaacucugcugaucgucaccaucggugccaccaugcugguguuggcugugacugugaccucccucugcaucuacuuggaucugcccugguaucucaggauggugugccaguggacccagacucggcgcagggccaggaacauacccuuagaagaacuccaaagaaaccuccaguuucaugcuuuuauuucauauagugaacaugauucugccugggugaaaagugaauugguaccuuaccuagaaaaagaagauauacagauuugucuucaugagagaaacuuugucccuggcaagagcauuguggaaaauaucaucaacugcauugagaagaguuacaaguccaucuuuguuuugucucccaacuuuguccagagugaguggugccauuacgaacucuauuuugcccaucacaaucucuuucaugaaggaucuaauaacuuaauccucaucuuacuggaacccauuccacagaacagcauucccaacaaguaccacaagcugaaggcucucaugaugcagcggacuuauuugcaguggcccaaggagaaaagcaaacgugggcucuuuugggcuaacauuagagccgcuuuuaauaugaaauuaacacuagucacugaaaacaaugaugugaaaucuuaa

SEQ ID NO: 9748 - RNA, 2391 nt, Artificial Sequence
  derived and/or modified sequence opt1 from TLR6__Homo_sapiens__AAY88761
augaccaaggacaaggagcccaucgucaagagcuuccacuucgugugccugaugaucaucaucgugggcacccgcauccaguucagcgacgggaacgaguucgccguggacaagagcaagcggggccucauccacgucccgaaggaccugccccugaagacgaaggugcucgacaugucccagaacuacaucgccgagcuccaggugagcgacauguccuuccugagcgagcugaccguccugcgccugucccacaaccggauccagcuccuggaccugagcguguucaaguucaaccaggaccucgaguaccuggaccugucccacaaccagcuccagaagaucagcugccaccccaucguguccuuccgccaccuggaccugagcuucaacgacuucaaggcgcuccccaucugcaaggaguucgggaaccugucccagcugaacuuccucggccugagcgccaugaagcugcagaagcucgaccugcugccgaucgcccaccuccaccuguccuacauccugcucgaccugcggaacuacuacaucaaggagaacgagaccgagagccugcagauccucaacgccaagacccugcaccuggucuuccaccccacgucccucuucgccauccaggugaacaucagcgugaacacccuggggugccugcagcucaccaacaucaagcugaacgacgacaacugccaggucuucaucaaguuccuguccgagcucacccgcggccccacgcugcugaacuucacccucaaccacaucgagaccaccuggaagugccuggugcggguguuccaguuccuguggcccaagccggucgaguaccucaacaucuacaaccugacgaucaucgagagcauccgcgaggaggacuucaccuacagcaagaccacccugaaggcgcugacgaucgagcacaucaccaaccagguguuccucuucucccagaccgcccuguacaccauguucagcgagaugaacaucaugaugcugacgaucuccgacacccccuucauccacaugcucugcccccacgcccccagcaccuucaaguuccugaacuucacccagaacguguucacggacuccaucuucgagaagugcagcacccuggucaagcucgagacccugauccugcagaagaacggccucaaggaccuguucaagguggggcugaugaccaaggacaugccgucccucgagauccuggacgugagcuggaacucccuggagagcggccggcacaaggagaacugcacgugggucgaguccaucguggugcucaaccugagcuccaacaugcugaccgacagcgucuuccgcugccucccgccccggaucaaggugcuggaccugcacuccaacaagaucaagagcauccccaagcaggucgugaagcucgaggcccugcaggagcugaacguggcguucaacucccucaccgaccugcccgggugcggcagcuucuccagccugagcguccucaucaucgaccacaacuccgugagccaccccuccgccgacuucuuccagagcugccagaagaugcgcuccaucaaggccggggacaaccccuuccagugcacgugcgagcugcgggaguucgugaagaacaucgaccaggucagcuccgaggugcuggagggcuggcccgacagcuacaagugcgacuacccggaguccuaccgcggcagcccccucaaggacuuccacauguccgagcugagcugcaacaucacccugcucaucgugaccaucggggccaccaugcugguccuggccgugaccgugacgucccucugcaucuaccuggaccugcccugguaccuccggauggucugccaguggacccagacccgccggcgcgcgcggaacaucccccuggaggagcugcagcgcaaccuccaguuccacgccuucaucagcuacuccgagcacgacagcgccugggugaaguccgagcuggugccguaccuggagaaggaggacauccagaucugccuccacgagcggaacuucguccccggcaagagcaucguggagaacaucaucaacugcaucgagaaguccuacaagagcaucuucgugcugagccccaacuucguccaguccgaguggugccacuacgagcuguacuucgcccaccacaaccucuuccacgaggggagcaacaaccugauccugauccuccuggagcccaucccgcagaacuccauccccaacaaguaccacaagcugaaggcccucaugaugcagcgcaccuaccugcaguggcccaaggagaaguccaagcgcggccuguucugggcgaacauccgggccgccuucaacaugaagcucacccuggugacggagaacaacgacgugaaguccuga

SEQ ID NO: 9749 - RNA, 2391 nt, Artificial Sequence
  derived and/or modified sequence opt2 from TLR6__Homo_sapiens__AAY88761
augaccaaggacaaggagcccaucgucaaguccuuccacuucgucugccucaugaucaucaucgucggcacccgcauccaguucuccgacggcaacgaguucgccgucgacaaguccaagcgcggccucauccacguccccaaggaccucccccucaagaccaagguccucgacaugucccagaacuacaucgccgagcuccaggucuccgacauguccuuccucuccgagcucaccguccuccgccucucccacaaccgcauccagcuccucgaccucuccgucuucaaguucaaccaggaccucgaguaccucgaccucucccacaaccagcuccagaagaucuccugccaccccaucgucuccuuccgccaccucgaccucuccuucaacgacuucaaggcccuccccaucugcaaggaguucggcaaccucucccagcucaacuuccucggccucuccgccaugaagcuccagaagcucgaccuccuccccaucgcccaccuccaccucuccuacauccuccucgaccuccgcaacuacuacaucaaggagaacgagaccgagucccuccagauccucaacgccaagacccuccaccucgucuuccaccccaccucccucuucgccauccaggucaacaucuccgucaacacccucggcugccuccagcucaccaacaucaagcucaacgacgacaacugccaggucuucaucaaguuccucuccgagcucacccgcggccccacccuccucaacuucacccucaaccacaucgagaccaccuggaagugccucguccgcgucuuccaguuccucuggcccaagcccgucgaguaccucaacaucuacaaccucaccaucaucgaguccauccgcgaggaggacuucaccuacuccaagaccacccucaaggcccucaccaucgagcacaucaccaaccaggucuuccucuucucccagaccgcccucuacaccauguucuccgagaugaacaucaugaugcucaccaucuccgacacccccuucauccacaugcucugcccccacgcccccuccaccuucaaguuccucaacuucacccagaacgucuucaccgacuccaucuucgagaagugcuccacccucgucaagcucgagacccucauccuccagaagaacggccucaaggaccucuucaaggucggccucaugaccaaggacaugcccucccucgagauccucgacgucuccuggaacucccucgaguccggccgccacaaggagaacugcaccugggucgaguccaucgucguccucaaccucuccuccaacaugcucaccgacuccgucuuccgcugccuccccccccgcaucaagguccucgaccuccacuccaacaagaucaaguccauccccaagcaggucgucaagcucgaggcccuccaggagcucaacgucgccuucaacucccucaccgaccuccccggcugcggcuccuucuccucccucuccguccucaucaucgaccacaacuccgucucccaccccuccgccgacuucuuccaguccugccagaagaugcgcuccaucaaggccggcgacaaccccuuccagugcaccugcgagcuccgcgaguucgucaagaacaucgaccaggucuccuccgagguccucgagggcuggcccgacuccuacaagugcgacuaccccgaguccuaccgcggcuccccccucaaggacuuccacauguccgagcucuccugcaacaucacccuccucaucgucaccaucggcgccaccaugcucguccucgccgucaccgucaccucccucugcaucuaccucgaccuccccugguaccuccgcauggucugccaguggacccagacccgccgccgcgcccgcaacaucccccucgaggagcuccagcgcaaccuccaguuccacgccuucaucuccuacuccgagcacgacuccgccugggucaaguccgagcucguccccuaccucgagaaggaggacauccagaucugccuccacgagcgcaacuucguccccggcaaguccaucgucgagaacaucaucaacugcaucgagaaguccuacaaguccaucuucguccucucccccaacuucguccaguccgaguggugccacuacgagcucuacuucgcccaccacaaccucuuccacgagggcuccaacaaccucauccucauccuccucgagcccaucccccagaacuccauccccaacaaguaccacaagcucaaggcccucaugaugcagcgcaccuaccuccaguggcccaaggagaaguccaagcgcggccucuucugggccaacauccgcgccgccuucaacaugaagcucacccucgucaccgagaacaacgacgucaaguccuga

SEQ ID NO: 9750 - RNA, 2391 nt, Artificial Sequence
  derived and/or modified sequence opt3 from TLR6__Homo_sapiens__AAY88761
augaccaaggacaaagagcccaucgucaagagcuuccacuuugugugccugaugauuauaaucguuggcacaaggauucaguucuccgaugggaacgaauuugccguggacaaaucuaagagaggacucauccauguaccuaaagaucuuccacugaagacuaagguguuggacaugucacaaaauuacauugcugaguuacaggucagugauaugagcuuccuguccgaacuaacggugcuccggcugucucacaaccgcauccagcuucuggacuugucgguuuuuaaauucaaucaggaucucgaguaucuggaccugucacauaaccaacuccagaagauaagcugucacccgaucgugaguuuucgacauuuagaucuguccuucaaugacuuuaaagcacuucccauuugcaaggaguucgguaacuugucucagcugaauuuucuaggccucagcgccaugaaacugcagaaacuugaucuguugccuaucgcgcaccuccaccuguccuacauuuuacuggaccuccguaacuauuacaucaaggagaaugagaccgaaucacuucaaauacugaacgcuaagacauugcaucuagucuuccacccaacuucccuguuugccauucaggugaauaucagcguaaacacccucgggugucugcagcuuacaaauauuaagcugaacgaugacaauugccagguuuucaucaaauucuugucugagcucaccagaggacccacucuguuaaacuuuacacugaaccauaucgaaaccacguggaagugucuagugagggucuuccaauuucucuggccuaaaccaguggaguaucugaauauuuacaaccuuacuauaaucgaguccauucgggaagaggacuucaccuauucaaagacaacuuugaaagcacugaccaucgaacacauaacaaaucagguguuucucuucagccagaccgcccuguacacgauguuuagugagaugaacauuaugaugcuuacuaucucugauacacccuucauccacaugcugugcccucaugcuccauccaccuuuaaguucuugaauuuuacucaaaacgucuucacagacagcauuuuugaaaaguguucgacccucguuaaacuggagacguuaauccugcagaagaauggccuaaaagaucucuucaaggugggucugaugaccaaagacaugccgucucuugagauuuuggauguauccuggaacucacuggaaagugggcgccacaaggagaauugcacauggguggaaagcauagucgugcucaaccuguccucuaauauguuaacugacagcguuuucagaugucugcccccuaggaucaaggugcuugauuugcauucaaacaaaauuaagaguaucccaaaacaggucgugaagcucgaggcacugcaggaacuaaauguagccuuuaacucccugaccgaccuccccggaugcggcagcuucucuucacugaguguucuuaucauugaucacaauagcgugucccauccuucugcugacuuuuuccaaucgugucagaaaaugcggagcauaaaggccggcgauaacccauuucagugcacaugcgaguugcgcgaguucgucaagaacaucgaccagguguccucagaaguccuggagggguggcccgacaguuacaaaugugauuauccggaaucuuaccgaggaagcccuuuaaaggacuuucacauguccgagcucucaugcaauauuacucugcuuaucgugaccauuggugcgacaaugcugguuuuggcagugaccguaacuagccucuguaucuaucuggaucuacccugguaccugagaauggucugccaauggacgcagacaaggcggcgugcccgcaacauaccacucgaagaacugcagagaaaucuucaguuccacgcuuuuaucucuuauuccgagcaugacagugccugggugaaaagcgaauugguuccuuaccuggagaaggaagauauucaaaucuguuuacacgagaggaacuucgugcccggcaaaucuauugucgagaauaucauaaacugcauugaaaaguccuauaagucaaucuuugugcucaguccaaauuucguacagagcgaguggugucauuacgaacuguacuuugcacaccacaaccuuuuccaugaggggucgaauaaccugauucuaauccuccuggaacccauaccucagaauaguaucccaaacaaauaucacaaguugaaagcucugaugaugcagcggaccuacuuacaauggccgaaggagaaaucuaagcgaggacucuucugggccaauauucgcgcggccuuuaacaugaaacugacucuugugaccgagaauaacgacguuaagagcuga

SEQ ID NO: 9751 - RNA, 2391 nt, Artificial Sequence
  derived and/or modified sequence opt4 from TLR6__Homo_sapiens__AAY88761
augaccaaggacaaggagcccaucgugaagagcuuccacuucgugugccugaugaucaucaucgugggcaccagaauccaguucagcgacggcaacgaguucgccguggacaagagcaagagaggccugauccacgugcccaaggaccugccccugaagaccaaggugcuggacaugagccagaacuacaucgccgagcugcaggugagcgacaugagcuuccugagcgagcugaccgugcugagacugagccacaacagaauccagcugcuggaccugagcguguucaaguucaaccaggaccuggaguaccuggaccugagccacaaccagcugcagaagaucagcugccaccccaucgugagcuucagacaccuggaccugagcuucaacgacuucaaggcccugcccaucugcaaggaguucggcaaccugagccagcugaacuuccugggccugagcgccaugaagcugcagaagcuggaccugcugcccaucgcccaccugcaccugagcuacauccugcuggaccugagaaacuacuacaucaaggagaacgagaccgagagccugcagauccugaacgccaagacccugcaccugguguuccaccccaccagccuguucgccauccaggugaacaucagcgugaacacccugggcugccugcagcugaccaacaucaagcugaacgacgacaacugccagguguucaucaaguuccugagcgagcugaccagaggccccacccugcugaacuucacccugaaccacaucgagaccaccuggaagugccuggugagaguguuccaguuccuguggcccaagcccguggaguaccugaacaucuacaaccugaccaucaucgagagcaucagagaggaggacuucaccuacagcaagaccacccugaaggcccugaccaucgagcacaucaccaaccagguguuccuguucagccagaccgcccuguacaccauguucagcgagaugaacaucaugaugcugaccaucagcgacacccccuucauccacaugcugugcccccacgcccccagcaccuucaaguuccugaacuucacccagaacguguucaccgacagcaucuucgagaagugcagcacccuggugaagcuggagacccugauccugcagaagaacggccugaaggaccuguucaaggugggccugaugaccaaggacaugcccagccuggagauccuggacgugagcuggaacagccuggagagcggcagacacaaggagaacugcaccuggguggagagcaucguggugcugaaccugagcagcaacaugcugaccgacagcguguucagaugccugccccccagaaucaaggugcuggaccugcacagcaacaagaucaagagcauccccaagcagguggugaagcuggaggcccugcaggagcugaacguggccuucaacagccugaccgaccugcccggcugcggcagcuucagcagccugagcgugcugaucaucgaccacaacagcgugagccaccccagcgccgacuucuuccagagcugccagaagaugagaagcaucaaggccggcgacaaccccuuccagugcaccugcgagcugagagaguucgugaagaacaucgaccaggugagcagcgaggugcuggagggcuggcccgacagcuacaagugcgacuaccccgagagcuacagaggcagcccccugaaggacuuccacaugagcgagcugagcugcaacaucacccugcugaucgugaccaucggcgccaccaugcuggugcuggccgugaccgugaccagccugugcaucuaccuggaccugcccugguaccugagaauggugugccaguggacccagaccagaagaagagccagaaacaucccccuggaggagcugcagagaaaccugcaguuccacgccuucaucagcuacagcgagcacgacagcgccugggugaagagcgagcuggugcccuaccuggagaaggaggacauccagaucugccugcacgagagaaacuucgugcccggcaagagcaucguggagaacaucaucaacugcaucgagaagagcuacaagagcaucuucgugcugagccccaacuucgugcagagcgaguggugccacuacgagcuguacuucgcccaccacaaccuguuccacgagggcagcaacaaccugauccugauccugcuggagcccaucccccagaacagcauccccaacaaguaccacaagcugaaggcccugaugaugcagagaaccuaccugcaguggcccaaggagaagagcaagagaggccuguucugggccaacaucagagccgccuucaacaugaagcugacccuggugaccgagaacaacgacgugaagagcuga

SEQ ID NO: 9752 - RNA, 2391 nt, Artificial Sequence
  derived and/or modified sequence opt5 from TLR6__Homo_sapiens__AAY88761
augaccaaggacaaagagcccaucgugaaguccuuccacuuugucugccugaugauuaucauuguuggcacaagaauccaguucuccgaugggaacgaauuugccguggacaaaucuaagcggggacucauucaugugccuaaagaucugccgcuuaagacgaagguccuggacaugagccaaaauuacaucgcugagcuccagguguccgauaugucuuuccugagcgaacuuaccguucugcgccucucccacaacagaauccagcugcuggaccucucuguguuuaaauucaaucaggaucuggaguaucuugaccugagccauaaccaacuccagaagauuuccugucaccccaucgucagcuuucggcaucuggaucuuucuuucaaugacuuuaaagcccugccuauuugcaaggaguucggcaaccucucccagcugaauuuucuggggcucagcgcgaugaaacugcagaagcucgaucugcuccccaucgcucaucugcaccuuucuuacauucugcucgaccugcgcaacuauuacaucaaggagaaugagacagaaucccugcaaauucucaacgccaaaacccugcaccuuguguuccacccuacaagccuguuugccauccagguuaauaucucugugaacacccucggaugucugcagcuuacaaauauuaagcugaacgaugacaauugccaggucuucaucaaauuccucuccgagcugaccagaggccccacgcugcucaacuuuacccugaaccauauugaaacaaccuggaagugucuugugcggguguuccaauuucuguggccuaaaccggucgaguaucucaauaucuacaaccugacaauuaucgagagcauccgcgaagaggacuucaccuauuccaagacgacacugaaagcucuuaccauugaacacaucacaaaucagguuuuucucuucucucagaccgcccuguacaccauguuuagcgagaugaacauuaugaugcugacaaucuccgauacgcccuucauucacaugcucugcccucaugcucccagcaccuuuaaguuccugaauuuuacacaaaacguguucaccgacucuaucuuugaaaaguguuccacacuugugaaacuggagacccucauccugcagaagaaugggcugaaagaucuuuucaaggucggacucaugacgaaagacaugccuagccuggagauucuggaugugucuuggaacagccucgaauccggcagacacaaggagaauugcacauggguugaaucuaucgugguccugaaccuuagcuccaauaugcugaccgacagcguguuccggugucuucccccgcgcauuaagguucuggaucugcauucuaacaaaaucaaguccauuccuaaacagguggucaaacuugaggcccuccaggaacugaauguggcguuuaacagccugaccgaccuccccggcugcgggucuuucuccagccuguccguccuuaucauugaucacaauucugugagccauccuuccgccgacuuuuuccaaucuugucagaagaugagaagcaucaaggcuggagauaaccccuuucagugcacaugcgagcugcgggaguucguuaagaacaucgaccagguguccagcgaaguccucgagggcuggcccgacucuuacaaaugugauuauccugaauccuaccgcgggagcccgcugaaggacuuucacaugucugagcuguccugcaauauuacccuucucaucgugacaauuggagccacgaugcugguucuggcugugaccgucacaagccucuguaucuaucuggaucuucccugguaccugagaauggugugccaauggacccagacacggcgcagagcccggaacauuccucucgaagaacugcagagaaaucugcaguuccacgcguuuaucucuuauagcgagcaugacuccgccugggugaaaagcgaacuuguucccuaccuggagaaggaagauauccaaauuugucuccacgagcgcaacuucgucccuggcaaaucuaucguggagaauauuaucaacugcauugaaaaguccuauaagagcaucuuugugcugucccccaauuucguccagucugaguggugucauuacgaacucuacuuugcucaccacaaccuguuccaugaggggagcaauaaccuuauccugauucuccuggaaccgaucccucagaauagcauucccaacaaauaucacaagcugaaagcccuuaugaugcagcggaccuaccugcaauggccuaaggagaaaucuaagagaggacucuucugggcuaauauccgcgccgccuuuaacaugaaacugacgcucgugaccgagaauaacgacguuaagagcuga

SEQ ID NO: 9753 - protein, 796 aa, Artificial Sequence [sequence omitted]

SEQ ID NO: 9754 - RNA, 2391 nt, Artificial Sequence
  TLR6__Homo_sapiens__AAY88762
augaccaaagacaaagaaccuauuguuaaaagcuuccauuuuguuugccuuaugaucauaauaguuggaaccagaauccaguucuccgacggaaaugaauuugcaguagacaagucaaaaagaggucuuauucauguuccaaaagaccuaccgcugaaaaccaaagucuuagauaugucucagaacuacaucgcugagcuucaggucucugacaugagcuuucuaucagaguugacaguuuugagacuuucccauaacagaauccagcuacuugauuuaaguguuuucaaguucaaccaggauuuagaauauuuggauuuaucucauaaucaguugcaaaagauauccugccauccuacugugaguuucaggcauuuagaucucucauucaaugauuucaaggcccugcccaucuguaaggaauuuggcaacuuaucacaacugaauuucuugggauugagugcuaugaagcugcaaaaauuagauuugcugccaauugcucacuugcaucuaaguuauauccuucuggauuuaagaaauuauuauauaaaagaaaaugagacagaaagucuacaaauucugaaugcaaaaacccuucaccuuguuuuucacccaacuaguuuauucgcuauccaagugaacauaucaguuaauacuuuagggugcuuacaacugacuaauauuaaauugaaugaugacaacugucaaguuuucauuaaauuuuuaucagaacucaccagagguccaaccuuacugaauuuuacccucaaccacauagaaacgacuuggaaaugccuggucagagucuuucaauuucuuuggcccaaaccuguggaauaucucaauauuuacaauuuaacaauaauugaaagcauucgugaagaagauuuuacuuauucuaaaacgacauugaaagcauugacaauagaacauaucacgaaccaaguuuuucuguuuucacagacagcuuuguacaccguguuuucugagaugaacauuaugauguuaaccauuucagauacaccuuuuauacacaugcuguguccucaugcaccaagcacauucaaguuuuugaacuuuacgcagaacguuuucacagauaguauuuuugaaaaauguuccacguuaguuaaauuggagacacuuaucuuacaaaagaauggauuaaaagaccuuuucaaaguaggucucaugacgaaggauaugccuucuuuggaaauacuggauguuagcuggaauucuuuggaaucugguagacauaaggaaaacugcacuuggguugagaguauagugguguuaaauuugucuucaaauaugcuuacugacucuguuuucagauguuuaccucccaggaucaagguacuugaucuucacagcaauaaaauaaagagcauuccuaaacaagucguaaaacuggaagcuuugcaagaacucaauguugcuuucaauucuuuaacugaccuuccuggauguggcagcuuuagcagccuuucuguauugaucauugaucacaauucaguuucccacccaucggcugauuucuuccagagcugccagaagaugaggucaauaaaagcaggggacaauccauuccaauguaccugugagcuaagagaauuugucaaaaauauagaccaaguaucaagugaaguguuagagggcuggccugauucuuauaagugugacuacccagaaaguuauagaggaagcccacuaaaggacuuucacaugucugaauuauccugcaacauaacucugcugaucgucaccaucggugccaccaugcugguguuggcugugacugugaccucccucugcaucuacuuggaucugcccugguaucucaggauggugugccaguggacccagacucggcgcagggccaggaacauacccuuagaagaacuccaaagaaaccuccaguuucaugcuuuuauuucauauagugaacaugauucugccugggugaaaagugaauugguaccuuaccuagaaaaagaagauauacagauuugucuucaugagagaaacuuugucccuggcaagagcauuguggaaaauaucaucaacugcauugagaagaguuacaaguccaucuuuguuuugucucccaacuuuguccagagugaguggugccauuacgaacucuauuuugcccaucacaaucucuuucaugaaggaucuaauaacuuaauccucaucuuacuggaacccauuccacagaacagcauucccaacaaguaccacaagcugaaggcucucaugaugcagcggacuuauuugcaguggcccaaggagaaaagcaaacgugggcucuuuugggcuaacauuagagccgcuuuuaauaugaaauuaacacuagucacugaaaacaaugaugugaaaucuuaa

SEQ ID NO: 9755 - RNA, 2391 nt, Artificial Sequence
  derived and/or modified sequence opt1 from TLR6__Homo_sapiens__AAY88762
augaccaaggacaaggagcccaucgucaagagcuuccacuucgugugccugaugaucaucaucgugggcacccgcauccaguucuccgacgggaacgaguucgccguggacaagagcaagcggggccucauccacgucccgaaggaccugccccugaagacgaaggugcucgacaugucccagaacuacaucgccgagcuccaggugagcgacauguccuuccugagcgagcugaccguccugcgccugucccacaaccggauccagcuccuggaccugagcguguucaaguucaaccaggaccucgaguaccuggaccugucccacaaccagcuccagaagaucagcugccaccccaccguguccuuccgccaccuggaccugagcuucaacgacuucaaggcgcuccccaucugcaaggaguucgggaaccugucccagcugaacuuccucggccugagcgccaugaagcugcagaagcucgaccugcugccgaucgcccaccuccaccuguccuacauccugcucgaccugcggaacuacuacaucaaggagaacgagaccgagagccugcagauccucaacgccaagacgcugcaccuggucuuccaccccaccucccucuucgccauccaggugaacaucagcgugaacacccuggggugccugcagcucaccaacaucaagcugaacgacgacaacugccaggucuucaucaaguuccuguccgagcucacgcgcggccccacccugcugaacuucacccucaaccacaucgagaccacguggaagugccuggugcggguguuccaguuccuguggcccaagccggucgaguaccucaacaucuacaaccugaccaucaucgagagcauccgcgaggaggacuucaccuacagcaagaccacgcugaaggcgcugaccaucgagcacaucaccaaccagguguuccucuucucccagaccgcccuguacacgguguucagcgagaugaacaucaugaugcugaccaucuccgacacccccuucauccacaugcucugcccccacgcccccagcaccuucaaguuccugaacuucacgcagaacgucuucaccgacuccaucuucgagaagugcagcacccuggugaagcucgagacccugauccugcagaagaacggccucaaggaccuguucaagguggggcugaugacgaaggacaugccgucccucgagauccuggacgucagcuggaacucccuggagagcggccggcacaaggagaacugcaccuggguggaguccaucgugguccucaaccugagcuccaacaugcugaccgacagcguguuccgcugccucccgccccggaucaagguccuggaccugcacuccaacaagaucaagagcauccccaagcaggucgugaagcucgaggcccugcaggagcugaacguggcguucaacucccucaccgaccugcccgggugcggcagcuucuccagccugagcgugcucaucaucgaccacaacuccgugagccaccccuccgccgacuucuuccagagcugccagaagaugcgcuccaucaaggccggggacaaccccuuccagugcacgugcgagcugcgggaguucgucaagaacaucgaccaggugagcuccgaggugcuggagggcuggcccgacagcuacaagugcgacuacccggaguccuaccgcggcagcccccucaaggacuuccacauguccgagcugagcugcaacaucacccugcucaucgucaccaucggggccaccaugcuggugcuggccgugacggucaccucccucugcaucuaccuggaccugcccugguaccuccggauggugugccaguggacccagacccgccggcgcgcgcggaacaucccccuggaggagcugcagcgcaaccuccaguuccacgccuucaucagcuacuccgagcacgacagcgccugggugaaguccgagcuggucccguaccuggagaaggaggacauccagaucugccuccacgagcggaacuucgugcccggcaagagcaucguggagaacaucaucaacugcaucgagaaguccuacaagagcaucuucguccugagccccaacuucgugcaguccgaguggugccacuacgagcuguacuucgcccaccacaaccucuuccacgaggggagcaacaaccugauccugauccuccuggagcccaucccgcagaacuccauccccaacaaguaccacaagcugaaggcccucaugaugcagcgcaccuaccugcaguggcccaaggagaaguccaagcgcggccuguucugggcgaacauccgggccgccuucaacaugaagcucacgcuggugaccgagaacaacgacgucaagagcuga

SEQ ID NO: 9756 - RNA, 2391 nt, Artificial Sequence
  derived and/or modified sequence opt2 from TLR6__Homo_sapiens__AAY88762
augaccaaggacaaggagcccaucgucaaguccuuccacuucgucugccucaugaucaucaucgucggcacccgcauccaguucuccgacggcaacgaguucgccgucgacaaguccaagcgcggccucauccacguccccaaggaccucccccucaagaccaagguccucgacaugucccagaacuacaucgccgagcuccaggucuccgacauguccuuccucuccgagcucaccguccuccgccucucccacaaccgcauccagcuccucgaccucuccgucuucaaguucaaccaggaccucgaguaccucgaccucucccacaaccagcuccagaagaucuccugccaccccaccgucuccuuccgccaccucgaccucuccuucaacgacuucaaggcccuccccaucugcaaggaguucggcaaccucucccagcucaacuuccucggccucuccgccaugaagcuccagaagcucgaccuccuccccaucgcccaccuccaccucuccuacauccuccucgaccuccgcaacuacuacaucaaggagaacgagaccgagucccuccagauccucaacgccaagacccuccaccucgucuuccaccccaccucccucuucgccauccaggucaacaucuccgucaacacccucggcugccuccagcucaccaacaucaagcucaacgacgacaacugccaggucuucaucaaguuccucuccgagcucacccgcggccccacccuccucaacuucacccucaaccacaucgagaccaccuggaagugccucguccgcgucuuccaguuccucuggcccaagcccgucgaguaccucaacaucuacaaccucaccaucaucgaguccauccgcgaggaggacuucaccuacuccaagaccacccucaaggcccucaccaucgagcacaucaccaaccaggucuuccucuucucccagaccgcccucuacaccgucuucuccgagaugaacaucaugaugcucaccaucuccgacacccccuucauccacaugcucugcccccacgcccccuccaccuucaaguuccucaacuucacccagaacgucuucaccgacuccaucuucgagaagugcuccacccucgucaagcucgagacccucauccuccagaagaacggccucaaggaccucuucaaggucggccucaugaccaaggacaugcccucccucgagauccucgacgucuccuggaacucccucgaguccggccgccacaaggagaacugcaccugggucgaguccaucgucguccucaaccucuccuccaacaugcucaccgacuccgucuuccgcugccuccccccccgcaucaagguccucgaccuccacuccaacaagaucaaguccauccccaagcaggucgucaagcucgaggcccuccaggagcucaacgucgccuucaacucccucaccgaccuccccggcugcggcuccuucuccucccucuccguccucaucaucgaccacaacuccgucucccaccccuccgccgacuucuuccaguccugccagaagaugcgcuccaucaaggccggcgacaaccccuuccagugcaccugcgagcuccgcgaguucgucaagaacaucgaccaggucuccuccgagguccucgagggcuggcccgacuccuacaagugcgacuaccccgaguccuaccgcggcuccccccucaaggacuuccacauguccgagcucuccugcaacaucacccuccucaucgucaccaucggcgccaccaugcucguccucgccgucaccgucaccucccucugcaucuaccucgaccuccccugguaccuccgcauggucugccaguggacccagacccgccgccgcgcccgcaacaucccccucgaggagcuccagcgcaaccuccaguuccacgccuucaucuccuacuccgagcacgacuccgccugggucaaguccgagcucguccccuaccucgagaaggaggacauccagaucugccuccacgagcgcaacuucguccccggcaaguccaucgucgagaacaucaucaacugcaucgagaaguccuacaaguccaucuucguccucucccccaacuucguccaguccgaguggugccacuacgagcucuacuucgcccaccacaaccucuuccacgagggcuccaacaaccucauccucauccuccucgagcccaucccccagaacuccauccccaacaaguaccacaagcucaaggcccucaugaugcagcgcaccuaccuccaguggcccaaggagaaguccaagcgcggccucuucugggccaacauccgcgccgccuucaacaugaagcucacccucgucaccgagaacaacgacgucaaguccuga

SEQ ID NO: 9757 - RNA, 2391 nt, Artificial Sequence
  derived and/or modified sequence opt3 from TLR6__Homo_sapiens__AAY88762
augaccaaggacaaagagcccaucgugaaguccuuccacuuugucugccugaugauuauaaucguuggcacaaggauucaguucuccgaugggaacgaauuugccguggacaaaucuaagagaggacucauccauguaccuaaagaucuuccacugaagacuaagguguuggacaugucacaaaauuacauugcugaguuacaggucagugauaugagcuuccuguccgaacuaacggugcuccggcugucucacaaccgcauccagcuucuggacuugucgguuuuuaaauucaaucaggaucucgaguaucuggaccugucacauaaccaacuccagaagauaagcugucacccgaccgugaguuuucgacauuuagaucuguccuucaaugacuuuaaagcacuucccaucugcaaggaguucgguaacuugucucagcugaauuuucuaggccucagcgccaugaaacugcagaaacuugaucuguugccuauugcgcaccuccaccuguccuacaucuuacuggaccuccguaacuauuacauuaaggagaaugagacagaaucacuucaaauccugaacgcuaagacuuugcaucuagucuuccacccaaccagucuguuugccauacaggugaauauuagcguaaacacacucgggugucugcagcuuaccaauaucaagcugaacgaugacaauugccagguuuucauuaaauucuugucugagcucacuagaggacccacacuguuaaacuuuacccugaaccauaucgaaacgacuuggaagugucuagugagggucuuccaauuucucuggccuaaaccaguggaguaucugaauaucuacaaccuuaccauuauagaguccauccgggaagaggacuucacauauucaaagacuaccuugaaagcacugacaauugaacacaucaccaaucagguguuucucuucagccagacggcccuguacacugucuuuagugagaugaacauaaugaugcuuacaauuucugauacccccuucauccacaugcugugcccucaugcuccauccacuuuuaaguucuugaauuuuacacaaaacguuuucaccgacagcaucuuugaaaaguguucgacgcucgugaaacuggagaccuuaauucugcagaagaauggccuaaaagaucucuucaagguaggucugaugacaaaagacaugccgucucuugagaucuuggauguguccuggaacucacuggaaagugggcgccacaaggagaauugcacuugggucgaaagcauugugguucucaaccuguccucuaauauguuaaccgacagcguguucagaugucugcccccuaggauaaagguccuugauuugcauucaaacaaaaucaagaguauuccaaaacaggugguaaagcucgaggcacugcaggaacuaaauguugccuuuaacucccugacagaccuccccggaugcggcagcuucucuucacugagugugcuuaucaucgaucacaauagcgucucccauccuucugcugacuuuuuccaaucgugucagaaaaugcggagcauuaaggccggcgauaacccauuucagugcacuugcgaguugcgcgaguucgugaagaacauagaccaggucuccucagaagugcuggagggguggcccgacaguuacaaaugugauuauccggaaucuuaccgaggaagcccuuuaaaggacuuucacauguccgagcucucaugcaauaucacccugcuuauuguuacaaucggugcgaccaugcugguguuggcaguaacugucacgagccucuguauuuaucuggaucuacccugguaccugagaauggugugccaauggacacagaccaggcggcgugcccgcaacaucccacucgaagaacugcagagaaaucuucaguuccacgcuuuuauaucuuauuccgagcaugacagugccuggguuaaaagcgaauuggugccuuaccuggagaaggaagauauccaaauuuguuuacacgagaggaacuucguccccggcaaaucuaucguggagaauauuaucaacugcauagaaaaguccuauaagucaauuuuuguacucaguccaaauuucgugcagagcgaguggugucauuacgaacuguacuuugcacaccacaaccuuuuccaugaggggucgaauaaccugauccuaauucuccuggaacccaucccucagaauagcauaccaaacaaauaucacaaguugaaagcucugaugaugcagcggacuuacuuacaauggccgaaggagaaaucuaagcgaggacucuucugggccaauauccgcgcggccuuuaacaugaaacugacccuuguuacagagaauaacgacgucaagagcuga

SEQ ID NO: 9758 - RNA, 2391 nt, Artificial Sequence
  derived and/or modified sequence opt4 from TLR6__Homo_sapiens__AAY88762
augaccaaggacaaggagcccaucgugaagagcuuccacuucgugugccugaugaucaucaucgugggcaccagaauccaguucagcgacggcaacgaguucgccguggacaagagcaagagaggccugauccacgugcccaaggaccugccccugaagaccaaggugcuggacaugagccagaacuacaucgccgagcugcaggugagcgacaugagcuuccugagcgagcugaccgugcugagacugagccacaacagaauccagcugcuggaccugagcguguucaaguucaaccaggaccuggaguaccuggaccugagccacaaccagcugcagaagaucagcugccaccccaccgugagcuucagacaccuggaccugagcuucaacgacuucaaggcccugcccaucugcaaggaguucggcaaccugagccagcugaacuuccugggccugagcgccaugaagcugcagaagcuggaccugcugcccaucgcccaccugcaccugagcuacauccugcuggaccugagaaacuacuacaucaaggagaacgagaccgagagccugcagauccugaacgccaagacccugcaccugguguuccaccccaccagccuguucgccauccaggugaacaucagcgugaacacccugggcugccugcagcugaccaacaucaagcugaacgacgacaacugccagguguucaucaaguuccugagcgagcugaccagaggccccacccugcugaacuucacccugaaccacaucgagaccaccuggaagugccuggugagaguguuccaguuccuguggcccaagcccguggaguaccugaacaucuacaaccugaccaucaucgagagcaucagagaggaggacuucaccuacagcaagaccacccugaaggcccugaccaucgagcacaucaccaaccagguguuccuguucagccagaccgcccuguacaccguguucagcgagaugaacaucaugaugcugaccaucagcgacacccccuucauccacaugcugugcccccacgcccccagcaccuucaaguuccugaacuucacccagaacguguucaccgacagcaucuucgagaagugcagcacccuggugaagcuggagacccugauccugcagaagaacggccugaaggaccuguucaaggugggccugaugaccaaggacaugcccagccuggagauccuggacgugagcuggaacagccuggagagcggcagacacaaggagaacugcaccuggguggagagcaucguggugcugaaccugagcagcaacaugcugaccgacagcguguucagaugccugccccccagaaucaaggugcuggaccugcacagcaacaagaucaagagcauccccaagcagguggugaagcuggaggcccugcaggagcugaacguggccuucaacagccugaccgaccugcccggcugcggcagcuucagcagccugagcgugcugaucaucgaccacaacagcgugagccaccccagcgccgacuucuuccagagcugccagaagaugagaagcaucaaggccggcgacaaccccuuccagugcaccugcgagcugagagaguucgugaagaacaucgaccaggugagcagcgaggugcuggagggcuggcccgacagcuacaagugcgacuaccccgagagcuacagaggcagcccccugaaggacuuccacaugagcgagcugagcugcaacaucacccugcugaucgugaccaucggcgccaccaugcuggugcuggccgugaccgugaccagccugugcaucuaccuggaccugcccugguaccugagaauggugugccaguggacccagaccagaagaagagccagaaacaucccccuggaggagcugcagagaaaccugcaguuccacgccuucaucagcuacagcgagcacgacagcgccugggugaagagcgagcuggugcccuaccuggagaaggaggacauccagaucugccugcacgagagaaacuucgugcccggcaagagcaucguggagaacaucaucaacugcaucgagaagagcuacaagagcaucuucgugcugagccccaacuucgugcagagcgaguggugccacuacgagcuguacuucgcccaccacaaccuguuccacgagggcagcaacaaccugauccugauccugcuggagcccaucccccagaacagcauccccaacaaguaccacaagcugaaggcccugaugaugcagagaaccuaccugcaguggcccaaggagaagagcaagagaggccuguucugggccaacaucagagccgccuucaacaugaagcugacccuggugaccgagaacaacgacgugaagagcuga

SEQ ID NO: 9759 - RNA, 2391 nt, Artificial Sequence
  derived and/or modified sequence opt5 from TLR6__Homo_sapiens__AAY88762
augaccaaggacaaagagcccaucgugaaguccuuccacuuugugugccugaugauuaucauuguuggcacaagaauccaguucuccgaugggaacgaauuugccguggacaaaucuaagcggggacucauucaugugccuaaagaucugccgcuuaagacgaagguccuggacaugagccaaaauuacaucgcugagcuccagguguccgauaugucuuuccugagcgaacuuaccguucugcgccucucccacaacagaauccagcugcuggaccucucuguguuuaaauucaaucaggaucuggaguaucuugaccugagccauaaccaacuccagaagauuuccugucaccccacagucagcuuucggcaucuggaucuuucuuucaaugacuuuaaagcccugccuaucugcaaggaguucggcaaccucucccagcugaauuuucuggggcucagcgcgaugaaacugcagaagcucgaucugcuccccauugcucaucugcaccuuucuuacauccugcucgaccugcgcaacuauuacauuaaggagaaugagaccgaaucccugcaaauccucaacgccaaaacacugcaccuuguguuccacccuaccagccuguuugccauucagguuaauaucucugugaacacacucggaugucugcagcuuaccaauaucaagcugaacgaugacaauugccaggucuucauuaaauuccucuccgagcugacgagaggccccacccugcucaacuuuacacugaaccauaucgaaaccacauggaagugucuugugcggguguuccaauuucuguggccuaaaccggucgaguaucucaauauuuacaaccugaccaucauugagagcauccgcgaagaggacuucacguauuccaagacaacccugaaagcucuuacaaucgaacacauuaccaaucagguuuuucucuucucucagaccgcccuguacacaguguuuagcgagaugaacaucaugaugcugacgauuuccgauacccccuucauccacaugcucugcccucaugcucccagcacauuuaaguuccugaauuuuacccaaaacguguucacagacucuauuuuugaaaaguguuccacccuugucaaacuggagacgcucauccugcagaagaaugggcugaaagaucuuuucaaggugggacucaugacaaaagacaugccuagccuggagauccuggauguuucuuggaacagccucgaauccggcagacacaaggagaauugcaccuggguggaaucuauugucgugcugaaccuuagcuccaauaugcugaccgacagcguuuuccggugucuucccccgcgcaucaaggugcuggaucugcauucuaacaaaauuaaguccaucccuaaacaggucgugaaacuugaggcccuccaggaacugaaugucgcguuuaacagccugacagaccuccccggcugcgggucuuucuccagccuguccgugcuuauuaucgaucacaauucuguuagccauccuuccgccgacuuuuuccaaucuugucagaagaugagaagcauuaaggcuggagauaaccccuuucaguguaccugcgagcugcgggaguucgugaagaacaucgaccaggucuccagcgaagugcucgagggcuggcccgacucuuacaaaugcgauuauccugaauccuaccgcgggagcccgcugaaggacuuucacaugucugagcuguccugcaauaucacacuucucauuguuacgaucggagccaccaugcuggugcuggcugucacagugaccagccucuguauuuaucuggaucuucccugguaccugagaauggugugccaauggacacagacccggcgcagagcccggaacaucccucucgaagaacugcagagaaaucugcaguuccacgcguuuauuucuuauagcgagcaugacuccgccuggguuaaaagcgaacuuguccccuaccuggagaaggaagauauccaaaucugucuccacgagcgcaacuucgugccuggcaaaucuauuguggagaauaucauuaacugcaucgaaaaguccuauaagagcauuuuuguccugucccccaauuucgugcagucugaguggugucauuacgaacucuacuuugcucaccacaaccuguuccaugaggggagcaauaaccuuauccugauccuccuggaaccgauuccucagaauagcauccccaacaaauaucacaagcugaaagcccuuaugaugcagcggacguaccugcaauggccuaaggagaaaucuaagagaggacucuucugggcuaauauucgcgccgccuuuaacaugaaacugacccucguuacagagaauaacgacgucaagagcuga

SEQ ID NO: 9760 - protein, 1049 aa, Artificial Sequence
  TLR7__Homo_sapiens__B2R9N9
MVFPMWTLKRQILILFNIILISKLLGARWFPKTLPCDVTLDVPKNHVIVDCTDKHLTEIPGGIPTNTTNLTLTINHIPDISPASFHRLDHLVEIDFRCNCVPIPLGSKNNMCIKRLQIKPRSFSGLTYLKSLYLDGNQLLEIPQGLPPSLQLLSLEANNIFSIRKENLTELANIEILYLGQNCYYRNPCYVSYSIEKDAFLNLTKLKVLSLKDNNVTAVPTVLPSTLTELYLYNNMIAKIQEDDFNNLNQLQILDLSGNCPRCYNAPFPCAPCKNNSPLQIPVNAFDALTELKVLRLHSNSLQHVPPRWFKNINKLQELDLSQNFLAKEIGDAKFLHFLPSLIQLDLSFNFELQVYRASMNLSQAFSSLKSLKILRIRGYVFKELKSFNLSPLHNLQNLEVLDLGTNFIKIANLSMFKQFKRLKVIDLSVNKISPSGDSSEVGFCSNARTSVESYEPQVLEQLHYFRYDKYARSCRFKNKEASFMSVNESCYKYGQTLDLSKNSIFFVKSSDFQHLSFLKCLNLSGNLISQTLNGSEFQPLAELRYLDFSNNRLDLLHSTAFEELHKLEVLDISSNSHYFQSEGITHMLNFTKNLKVLQKLMMNDNDISSSTSRTMESESLRTLEFRGNHLDVLWREGDNRYLQLFKNLLKLEELDISKNSLSFLPSGVFDGMPPNLKNLSLAKNGLKSFSWKKLQCLKNLETLDLSHNQLTTVPERLSNCSRSLKNLILKNNQIRSLTKYFLQDAFQLRYLDLSSNKIQMIQKTSFPENVLNNLKMLLLHHNRFLCTCDAVWFVWWVNHTEVTIPYLATDVTCVGPGAHKGQSVISLDLYTCELDLTNLILFSLSISVSLFLMVMMTASHLYFWDVWYIYHFCKAKIKGYQRLISPDCCYDAFIVYDTKDPAVTEWVLAELVAKLEDPREKHFNLCLEERDWLPGQPVLENLSQSIQLSKKTVFVMTDKYAKTENFKIAFYLSHQRLMDEKVDVIILIFLEKPFQKSKFLQLRKRLCGSSVLEWPTNPQAHPYFWQCLKNALATDNHVAYSQVFKETV

SEQ ID NO: 9761 - RNA, 3150 nt, Artificial Sequence
  TLR7__Homo_sapiens__AAZ99022
augguguuuccaauguggacacugaagagacaaauucuuauccuuuuuaacauaauccuaauuuccaaacuccuuggggcuagaugguuuccuaaaacucugcccugugaugucacucuggauguuccaaagaaccaugugaucguggacugcacagacaagcauuugacagaaauuccuggagguauucccacgaacaccacgaaccucacccucaccauuaaccacauaccagacaucuccccagcguccuuucacagacuggaccaucugguagagaucgauuucagaugcaacuguguaccuauuccacuggggucaaaaaacaacaugugcaucaagaggcugcagauuaaacccagaagcuuuaguggacucacuuauuuaaaaucccuuuaccuggauggaaaccagcuacuagagauaccgcagggccucccgccuagcuuacagcuucucagccuugaggccaacaacaucuuuuccaucagaaaagagaaucuaacagaacuggccaacauagaaauacucuaccugggccaaaacuguuauuaucgaaauccuuguuauguuucauauucaauagagaaagaugccuuccuaaacuugacaaaguuaaaagugcucucccugaaagauaacaaugucacagccgucccuacuguuuugccaucuacuuuaacagaacuauaucucuacaacaacaugauugcaaaaauccaagaagaugauuuuaauaaccucaaccaauuacaaauucuugaccuaaguggaaauugcccucguuguuauaaugccccauuuccuugugcgccguguaaaaauaauucuccccuacagaucccuguaaaugcuuuugaugcgcugacagaauuaaaaguuuuacgucuacacaguaacucucuucagcaugugcccccaagaugguuuaagaacaucaacaaacuccaggaacuggaucugucccaaaacuucuuggccaaagaaauuggggaugcuaaauuucugcauuuucuccccagccucauccaauuggaucugucuuucaauuuugaacuucaggucuaucgugcaucuaugaaucuaucacaagcauuuucuucacugaaaagccugaaaauucugcggaucagaggauaugucuuuaaagaguugaaaagcuuuaaccucucgccauuacauaaucuucaaaaucuugaaguucuugaucuuggcacuaacuuuauaaaaauugcuaaccucagcauguuuaaacaauuuaaaagacugaaagucauagaucuuucagugaauaaaauaucaccuucaggagauucaagugaaguuggcuucugcucaaaugccagaacuucuguagaaaguuaugaaccccagguccuggaacaauuacauuauuucagauaugauaaguaugcaaggaguugcagauucaaaaacaaagaggcuucuuucaugucuguuaaugaaagcugcuacaaguaugggcagaccuuggaucuaaguaaaaauaguauauuuuuugucaaguccucugauuuucagcaucuuucuuuccucaaaugccugaaucugucaggaaaucucauuagccaaacucuuaauggcagugaauuccaaccuuuagcagagcugagauauuuggacuucuccaacaaccggcuugauuuacuccauucaacagcauuugaagagcuucacaaacuggaaguucuggauauaagcaguaauagccauuauuuucaaucagaaggaauuacucauaugcuaaacuuuaccaagaaccuaaagguucugcagaaacugaugaugaacgacaaugacaucucuuccuccaccagcaggaccauggagagugagucucuuagaacucuggaauucagaggaaaucacuuagauguuuuauggagagaaggugauaacagauacuuacaauuauucaagaaucugcuaaaauuagaggaauuagacaucucuaaaaauucccuaaguuucuugccuucuggaguuuuugaugguaugccuccaaaucuaaagaaucucucuuuggccaaaaaugggcucaaaucuuucaguuggaagaaacuccagugucuaaagaaccuggaaacuuuggaccucagccacaaccaacugaccacugucccugagagauuauccaacuguuccagaagccucaagaaucugauucuuaagaauaaucaaaucaggagucugacgaaguauuuucuacaagaugccuuccaguugcgauaucuggaucucagcucaaauaaaauccagaugauccaaaagaccagcuucccagaaaauguccucaacaaucugaagauguugcuuuugcaucauaaucgguuucugugcaccugugaugcugugugguuugucugguggguuaaccauacggaggugacuauuccuuaccuggccacagaugugacuuguguggggccaggagcacacaagggccaaagugugaucucccuggaucuguacaccugugaguuagaucugacuaaccugauucuguucucacuuuccauaucuguaucucucuuucucauggugaugaugacagcaagucaccucuauuucugggaugugugguauauuuaccauuucuguaaggccaagauaaagggguaucagcgucuaauaucaccagacuguugcuaugaugcuuuuauuguguaugacacuaaagacccagcugugaccgaguggguuuuggcugagcugguggccaaacuggaagacccaagagagaaacauuuuaauuuaugucucgaggaaagggacugguuaccagggcagccaguucuggaaaaccuuucccagagcauacagcuuagcaaaaagacaguguuugugaugacagacaaguaugcaaagacugaaaauuuuaagauagcauuuuacuugucccaucagaggcucauggaugaaaaaguugaugugauuaucuugauauuucuugagaagcccuuucagaaguccaaguuccuccagcuccggaaaaggcucugugggaguucuguccuugaguggccaacaaacccgcaagcucacccauacuucuggcagugucugaagaacgcccuggccacagacaaucauguggccuauagucagguguucaaggaaacggucuag

SEQ ID NO: 9762 - RNA, 3150 nt, Artificial Sequence
  derived and/or modified sequence opt1 from TLR7__Homo_sapiens__AAZ99022
augguguuccccauguggacccugaagcgccagauccucauccuguucaacaucauccugaucagcaagcuccugggcgcccggugguucccgaagacccugcccugcgacgucacgcucgacgugcccaagaaccacgugaucgucgacugcaccgacaagcaccugaccgagauccccgggggcaucccgaccaacacgaccaaccugacccucaccaucaaccacauccccgacaucucccccgccagcuuccaccgccuggaccaccugguggagaucgacuuccggugcaacugcgugcccaucccgcucggguccaagaacaacaugugcaucaagcgccugcagaucaagccccggagcuucuccggccugacguaccucaagagccuguaccuggacgggaaccagcuccuggagaucccccagggccugcccccgucccuccagcugcugagccucgaggcgaacaacaucuucuccauccgcaaggagaaccugaccgagcuggccaacaucgagauccucuaccugggccagaacugcuacuaccggaaccccugcuacgucagcuacuccaucgagaaggacgccuuccugaaccucaccaagcugaaggugcugagccucaaggacaacaacgugaccgccguccccacggugcugcccuccacccugaccgagcucuaccuguacaacaacaugaucgccaagauccaggaggacgacuucaacaaccugaaccagcuccagauccuggaccugagcgggaacugcccgcgcugcuacaacgcgcccuuccccugcgcccccugcaagaacaacuccccgcuccagauccccgugaacgccuucgacgcccugaccgagcugaagguccuccggcugcacagcaacucccugcagcacgugccgccccgcugguucaagaacaucaacaagcuccaggagcuggaccugagccagaacuuccuggcgaaggagaucggcgacgccaaguuccuccacuuccugcccucccugauccagcucgaccugagcuucaacuucgagcuccagguguaccgggccagcaugaaccucucccaggccuucagcucccucaagagccugaagauccugcgcauccggggguacgucuucaaggagcugaaguccuucaaccugagcccccuccacaaccugcagaaccuggaggugcucgaccugggcacgaacuucaucaagaucgccaaccuguccauguucaagcaguucaagcgccucaaggugaucgaccugagcgucaacaagaucucccccagcggggacuccagcgaggugggcuucugcuccaacgcgcggaccagcguggaguccuacgagccccagguccuggagcagcuccacuacuuccgcuacgacaaguacgcccggagcugccgcuucaagaacaaggaggccuccuucaugagcgugaacgaguccugcuacaaguacggccagacccuggaccugagcaagaacagcaucuucuucgugaaguccagcgacuuccagcaccucuccuuccugaagugccugaaccucagcgggaaccugaucucccagacccugaacggcagcgaguuccagccgcucgccgagcugcgguaccuggacuucuccaacaaccgccucgaccugcugcacagcacggccuucgaggagcuccacaagcuggagguccuggacaucuccagcaacucccacuacuuccagagcgaggggaucacccacaugcucaacuucaccaagaaccugaaggugcugcagaagcucaugaugaacgacaacgacaucuccagcuccaccagccggacgauggaguccgagagccugcgcacccuggaguuccgcggcaaccaccucgacguccuguggcgggagggcgacaaccgcuaccugcagcuguucaagaaccugcugaagcucgaggagcuggacaucagcaagaacucccugagcuuccuccccuccgggguguucgacggcaugcccccgaaccugaagaaccugagccucgcgaagaacgggcugaaguccuucagcuggaagaagcugcagugccucaagaaccuggagacccuggaccucucccacaaccagcugaccacggugcccgagcggcugagcaacugcucccgcagccucaagaaccugauccugaagaacaaccagauccggucccucaccaaguacuuccugcaggacgccuuccagcugcgcuaccucgaccugagcuccaacaagauccagaugauccagaagaccagcuuccccgagaacguccugaacaaccucaagaugcugcugcuccaccacaaccgguuccugugcacgugcgacgccgugugguucguguggugggucaaccacaccgaggugaccauccccuaccuggccaccgacgugaccugcgucggcccgggggcccacaagggccaguccgugaucagccucgaccuguacacgugcgagcuggaccucaccaaccugauccuguucucccucagcaucuccgugagccuguuccugauggucaugaugaccgcgagccaccucuacuucugggacgugugguacaucuaccacuucugcaaggccaagaucaagggcuaccagcgccugaucucccccgacugcugcuacgacgccuucaucguguacgacaccaaggaccccgccgucaccgagugggugcuggccgagcucguggcgaagcuggaggacccccgggagaagcacuucaaccugugccuggaggagcgcgacuggcucccggggcagcccguccuggagaaccugagccaguccauccagcucagcaagaagacgguguucgugaugaccgacaaguacgccaagaccgagaacuucaagaucgccuucuaccugucccaccagcggcugauggacgagaaggucgacgugaucauccucaucuuccuggagaagcccuuccagaaguccaaguuccugcagcuccgcaagcggcugugcggcagcagcgugcuggaguggcccaccaacccgcaggcccaccccuacuucuggcagugccucaagaacgcgcuggccacggacaaccacgucgccuacucccagguguucaaggagaccguguga

SEQ ID NO: 9763 - RNA, 3150 nt, Artificial Sequence
  derived and/or modified sequence opt2 from TLR7__Homo_sapiens__AAZ99022
auggucuuccccauguggacccucaagcgccagauccucauccucuucaacaucauccucaucuccaagcuccucggcgcccgcugguuccccaagacccuccccugcgacgucacccucgacguccccaagaaccacgucaucgucgacugcaccgacaagcaccucaccgagauccccggcggcauccccaccaacaccaccaaccucacccucaccaucaaccacauccccgacaucucccccgccuccuuccaccgccucgaccaccucgucgagaucgacuuccgcugcaacugcguccccaucccccucggcuccaagaacaacaugugcaucaagcgccuccagaucaagccccgcuccuucuccggccucaccuaccucaagucccucuaccucgacggcaaccagcuccucgagaucccccagggccucccccccucccuccagcuccucucccucgaggccaacaacaucuucuccauccgcaaggagaaccucaccgagcucgccaacaucgagauccucuaccucggccagaacugcuacuaccgcaaccccugcuacgucuccuacuccaucgagaaggacgccuuccucaaccucaccaagcucaagguccucucccucaaggacaacaacgucaccgccguccccaccguccuccccuccacccucaccgagcucuaccucuacaacaacaugaucgccaagauccaggaggacgacuucaacaaccucaaccagcuccagauccucgaccucuccggcaacugcccccgcugcuacaacgcccccuuccccugcgcccccugcaagaacaacuccccccuccagauccccgucaacgccuucgacgcccucaccgagcucaagguccuccgccuccacuccaacucccuccagcacguccccccccgcugguucaagaacaucaacaagcuccaggagcucgaccucucccagaacuuccucgccaaggagaucggcgacgccaaguuccuccacuuccuccccucccucauccagcucgaccucuccuucaacuucgagcuccaggucuaccgcgccuccaugaaccucucccaggccuucuccucccucaagucccucaagauccuccgcauccgcggcuacgucuucaaggagcucaaguccuucaaccucuccccccuccacaaccuccagaaccucgagguccucgaccucggcaccaacuucaucaagaucgccaaccucuccauguucaagcaguucaagcgccucaaggucaucgaccucuccgucaacaagaucucccccuccggcgacuccuccgaggucggcuucugcuccaacgcccgcaccuccgucgaguccuacgagccccagguccucgagcagcuccacuacuuccgcuacgacaaguacgcccgcuccugccgcuucaagaacaaggaggccuccuucauguccgucaacgaguccugcuacaaguacggccagacccucgaccucuccaagaacuccaucuucuucgucaaguccuccgacuuccagcaccucuccuuccucaagugccucaaccucuccggcaaccucaucucccagacccucaacggcuccgaguuccagccccucgccgagcuccgcuaccucgacuucuccaacaaccgccucgaccuccuccacuccaccgccuucgaggagcuccacaagcucgagguccucgacaucuccuccaacucccacuacuuccaguccgagggcaucacccacaugcucaacuucaccaagaaccucaagguccuccagaagcucaugaugaacgacaacgacaucuccuccuccaccucccgcaccauggaguccgagucccuccgcacccucgaguuccgcggcaaccaccucgacguccucuggcgcgagggcgacaaccgcuaccuccagcucuucaagaaccuccucaagcucgaggagcucgacaucuccaagaacucccucuccuuccuccccuccggcgucuucgacggcaugccccccaaccucaagaaccucucccucgccaagaacggccucaaguccuucuccuggaagaagcuccagugccucaagaaccucgagacccucgaccucucccacaaccagcucaccaccguccccgagcgccucuccaacugcucccgcucccucaagaaccucauccucaagaacaaccagauccgcucccucaccaaguacuuccuccaggacgccuuccagcuccgcuaccucgaccucuccuccaacaagauccagaugauccagaagaccuccuuccccgagaacguccucaacaaccucaagaugcuccuccuccaccacaaccgcuuccucugcaccugcgacgccgucugguucgucuggugggucaaccacaccgaggucaccauccccuaccucgccaccgacgucaccugcgucggccccggcgcccacaagggccaguccgucaucucccucgaccucuacaccugcgagcucgaccucaccaaccucauccucuucucccucuccaucuccgucucccucuuccucauggucaugaugaccgccucccaccucuacuucugggacgucugguacaucuaccacuucugcaaggccaagaucaagggcuaccagcgccucaucucccccgacugcugcuacgacgccuucaucgucuacgacaccaaggaccccgccgucaccgaguggguccucgccgagcucgucgccaagcucgaggacccccgcgagaagcacuucaaccucugccucgaggagcgcgacuggcuccccggccagcccguccucgagaaccucucccaguccauccagcucuccaagaagaccgucuucgucaugaccgacaaguacgccaagaccgagaacuucaagaucgccuucuaccucucccaccagcgccucauggacgagaaggucgacgucaucauccucaucuuccucgagaagcccuuccagaaguccaaguuccuccagcuccgcaagcgccucugcggcuccuccguccucgaguggcccaccaacccccaggcccaccccuacuucuggcagugccucaagaacgcccucgccaccgacaaccacgucgccuacucccaggucuucaaggagaccgucuga

SEQ ID NO: 9764 - RNA, 3150 nt, Artificial Sequence
  derived and/or modified sequence opt3 from TLR7__Homo_sapiens__AAZ99022
augguguuccccauguggacccugaagagacagauccucauucuuuuuaacauaauccugauuagcaaauuguuaggcgccaggugguucccuaagacacugccaugcgacgucacucuagauguuccgaaaaaucacgugaucguagacuguacggauaagcaucucaccgagauucccgggggaaucccuacaaacacuaccaaucugacacuuaccauaaaccacaucccagacauuucccccgcuucuuuucaucggcuggaucacuugguggaaaucgacuuccgcugcaauugugucccuauuccacucgguagcaaaaacaauaugugcaucaagcgacugcaaauaaagccccguaguuuuagcggccugacuuaccucaaauccuuauaucuggaugggaaccagcuuuuggagauuccucagggacugccaccgucucuacagcuccugucgcuugaagcaaauaacaucuucucaauuagaaaggagaaucugacagaauuggccaacaucgagauccucuaccugggccaaaauuguuauuacaggaaccccugcuaugugagcuacaguauugagaaagacgcguuuuuaaaucugaccaagcucaaaguucuuucccugaaggauaacaacgugacggcugucccuacuguguugccaucuacccuaacagaacuguaucucuacaauaacaugauagccaagauccaggaggacgauuucaauaaccugaaucagcuucagauucuggacuugagcgguaacuguccccggugcuacaaugcaccuuuuccaugugcccccugcaaaaacaauuccccgcuccaaaucccuguaaacgcuuucgaugcacugacugaauuaaagguucugcgccuacauucaaauagucuccagcacgugcccccaagaugguuuaaaaacauaaauaagcugcaggagcuugacuugagccagaacuuccuggccaaagagauuggggacgcuaaguuucuccacuuccugccuucucuuauccaacuggauuuguccuucaauuuugaacuccaggucuauagggccucaaugaaccugagccaggcguucaguucuuuaaaaucccugaagauccuacggauucgcggauacguguuuaaggagcucaaaucauucaaccugucgccccuucauaauuugcaaaaccuggaagugcucgaccugggcaccaauuuuaucaagauugcaaacuuaucuauguucaaacaguuuaagcgacugaaagucauagaucuuuccguuaauaagaucucaccaaguggcgacagcuccgaggugggguucuguucuaacgccagaacaagcguagaaucauaugagccccagguguuggagcagcuccacuacuuuagguaugauaaguacgcucggaguugccguuucaaaaauaaggaagccuccuuuaugagcgucaacgagucuugcuauaaauacggacaaacccuggaccuaucaaagaauaguauuuucuuugugaaaagcuccgauuuccagcaucugucuuuccucaagugucugaaccuuucggguaauuugaucagccagacgcugaacggcuccgaauuucagccuuuagcagagcuccgcuaccuggacuucucaaauaacagacuugaucuguugcacaguacugcuuuugaagaacuccacaagcuggagguucuagacaucucuagcaauucccauuauuuccaaucagaagggauuacacacaugcugaacuuuaccaaaaaccucaaggugcugcagaaacuuaugaugaaugauaacgacauaaguucuuccacuagcaggacaauggagagcgaaucuuugcggacccuggaguuccgaggaaaucauuuagacguccucuggcgcgaaggcgauaacagauaccugcagcuuuuuaagaaucugcuaaaacucgaggagcuggacaucuccaagaacucauugaguuuccugccaagcgguguguuugaugggaugccgcccaauuuaaagaaccucucgcuggccaaaaauggacuuaaguccuucucuuggaaaaagcugcagugcuugaaaaaccucgaaacgcuggaccuaagccacaaucaacugaccacaguaccugagaggcuuucaaacuguagucggucccucaagaaucugauuuugaaaaacaaucagauccgcucucugacuaaguacuuuuuacaggaugcguuccagcucagauaucuggaccuuagcuccaacaagauucaaaugauccagaaaaccucauuuccagaaaacguucugaauaacuugaagaugcuccugcuacaucacaauagguuccugugcacaugugaugccgugugguucgucuggugggugaaccacacugaggucaccauacccuaucuugcaacagacgugaccugcguuggcccuggcgcucauaaagggcagagcgugaucagucucgaucuguacacuugugaguuggacuuaacgaaucugauucucuuuucucuguccaucagcguaucgcuuuuccugauggucaugaugacagccucacacuuguauuuuugggaugugugguacauuuaccauuucugcaaggcuaaaaucaagggauaucaacgucuaauaucuccagacuguugcuacgaugccuuuauuguuuaugacaccaaggaccccgcagugacugaauggguccuggccgagcucguggcuaaacuggaagauccgcgggagaagcacuucaaccuuuguuuagaggagcgagacuggcugccuggucagccaguacucgagaauuugagucaguccauccagcugagcaaaaagaccguguuuguuaugacagauaaauacgcgaagaccgaaaacuucaagauugcauuuuaucucucucaccaaagacugauggacgagaaagucgaugugaucauacuuaucuuccuggaaaagcccuuucagaaaagcaaguucuugcagcuaaggaaacgccugugcggcuccucagugcucgaguggccuacuaauccccaggcccauccauacuucuggcaaugcuuaaagaacgcucuggccacagacaaucacgucgcauauagucagguuuuuaaggaaacgguguga

SEQ ID NO: 9765 - RNA, 3150 nt, Artificial Sequence
  derived and/or modified sequence opt4 from TLR7__Homo_sapiens__AAZ99022
augguguuccccauguggacccugaagagacagauccugauccuguucaacaucauccugaucagcaagcugcugggcgccagaugguuccccaagacccugcccugcgacgugacccuggacgugcccaagaaccacgugaucguggacugcaccgacaagcaccugaccgagauccccggcggcauccccaccaacaccaccaaccugacccugaccaucaaccacauccccgacaucagccccgccagcuuccacagacuggaccaccugguggagaucgacuucagaugcaacugcgugcccaucccccugggcagcaagaacaacaugugcaucaagagacugcagaucaagcccagaagcuucagcggccugaccuaccugaagagccuguaccuggacggcaaccagcugcuggagaucccccagggccugccccccagccugcagcugcugagccuggaggccaacaacaucuucagcaucagaaaggagaaccugaccgagcuggccaacaucgagauccuguaccugggccagaacugcuacuacagaaaccccugcuacgugagcuacagcaucgagaaggacgccuuccugaaccugaccaagcugaaggugcugagccugaaggacaacaacgugaccgccgugcccaccgugcugcccagcacccugaccgagcuguaccuguacaacaacaugaucgccaagauccaggaggacgacuucaacaaccugaaccagcugcagauccuggaccugagcggcaacugccccagaugcuacaacgcccccuuccccugcgcccccugcaagaacaacagcccccugcagauccccgugaacgccuucgacgcccugaccgagcugaaggugcugagacugcacagcaacagccugcagcacgugccccccagaugguucaagaacaucaacaagcugcaggagcuggaccugagccagaacuuccuggccaaggagaucggcgacgccaaguuccugcacuuccugcccagccugauccagcuggaccugagcuucaacuucgagcugcagguguacagagccagcaugaaccugagccaggccuucagcagccugaagagccugaagauccugagaaucagaggcuacguguucaaggagcugaagagcuucaaccugagcccccugcacaaccugcagaaccuggaggugcuggaccugggcaccaacuucaucaagaucgccaaccugagcauguucaagcaguucaagagacugaaggugaucgaccugagcgugaacaagaucagccccagcggcgacagcagcgaggugggcuucugcagcaacgccagaaccagcguggagagcuacgagccccaggugcuggagcagcugcacuacuucagauacgacaaguacgccagaagcugcagauucaagaacaaggaggccagcuucaugagcgugaacgagagcugcuacaaguacggccagacccuggaccugagcaagaacagcaucuucuucgugaagagcagcgacuuccagcaccugagcuuccugaagugccugaaccugagcggcaaccugaucagccagacccugaacggcagcgaguuccagccccuggccgagcugagauaccuggacuucagcaacaacagacuggaccugcugcacagcaccgccuucgaggagcugcacaagcuggaggugcuggacaucagcagcaacagccacuacuuccagagcgagggcaucacccacaugcugaacuucaccaagaaccugaaggugcugcagaagcugaugaugaacgacaacgacaucagcagcagcaccagcagaaccauggagagcgagagccugagaacccuggaguucagaggcaaccaccuggacgugcuguggagagagggcgacaacagauaccugcagcuguucaagaaccugcugaagcuggaggagcuggacaucagcaagaacagccugagcuuccugcccagcggcguguucgacggcaugccccccaaccugaagaaccugagccuggccaagaacggccugaagagcuucagcuggaagaagcugcagugccugaagaaccuggagacccuggaccugagccacaaccagcugaccaccgugcccgagagacugagcaacugcagcagaagccugaagaaccugauccugaagaacaaccagaucagaagccugaccaaguacuuccugcaggacgccuuccagcugagauaccuggaccugagcagcaacaagauccagaugauccagaagaccagcuuccccgagaacgugcugaacaaccugaagaugcugcugcugcaccacaacagauuccugugcaccugcgacgccgugugguucguguggugggugaaccacaccgaggugaccauccccuaccuggccaccgacgugaccugcgugggccccggcgcccacaagggccagagcgugaucagccuggaccuguacaccugcgagcuggaccugaccaaccugauccuguucagccugagcaucagcgugagccuguuccugauggugaugaugaccgccagccaccuguacuucugggacgugugguacaucuaccacuucugcaaggccaagaucaagggcuaccagagacugaucagccccgacugcugcuacgacgccuucaucguguacgacaccaaggaccccgccgugaccgagugggugcuggccgagcugguggccaagcuggaggaccccagagagaagcacuucaaccugugccuggaggagagagacuggcugcccggccagcccgugcuggagaaccugagccagagcauccagcugagcaagaagaccguguucgugaugaccgacaaguacgccaagaccgagaacuucaagaucgccuucuaccugagccaccagagacugauggacgagaagguggacgugaucauccugaucuuccuggagaagcccuuccagaagagcaaguuccugcagcugagaaagagacugugcggcagcagcgugcuggaguggcccaccaacccccaggcccaccccuacuucuggcagugccugaagaacgcccuggccaccgacaaccacguggccuacagccagguguucaaggagaccguguga

SEQ ID NO: 9766 - RNA, 3150 nt, Artificial Sequence
  derived and/or modified sequence opt5 from TLR7__Homo_sapiens__AAZ99022
augguguuccccauguggacccugaagagacagauccucauucuguuuaacaucauucuuaucagcaaacugcucggcgcccggugguucccuaagacacugccgugcgacgucacgcuugauguucccaaaaaucacgugauuguggacuguaccgauaagcaucugacagagaucccugggggaauccccaccaacacaaccaaucucacacugaccauuaaccacaucccugacauuucccccgcuucuuuucaucgccuggaucaccucgucgaaaucgacuucagaugcaauugugugccuauuccgcugggcagcaaaaacaauaugugcaucaagcggcuucaaauuaagccccgcuccuuuucugggcugacguaccucaaaagccuguaucuugauggaaaccagcugcucgagaucccucagggccugcccccuucccugcagcuccugucucuugaagccaauaacaucuucagcauuagaaaggagaaucugaccgaacucgcgaacaucgagauucuguaccuugggcaaaauuguuauuaccggaaccccugcuauguuuccuacagcaucgagaaagacgcuuuucugaaucucacaaagcugaaagugcugucucucaaggauaacaacgucaccgccgugccgacaguucugccuuccacccuuacggaacuguaucucuacaauaacaugauugccaagauccaggaggacgauuucaauaaccugaaucagcuucagauccuggaccucagcggaaacuguccccgcugcuacaaugcuccuuuucccugugcccccugcaaaaacaauucuccucugcaaauuccggugaacgcuuucgaugcccugacagaacucaagguccugagacuucauuccaauagccugcagcacgugcccccucggugguuuaaaaacaucaauaagcuccaggagcuggaccugucucagaacuuccuugcgaaagagauuggcgacgccaaguuucuccacuuccugcccucccugauccaacucgaucugagcuucaauuuugaacuucagguguaucgcgcuuccaugaaccugucucaggccuucagcucccucaaaagccugaagauucugagaauccggggcuacgucuuuaaggagcuuaaaucuuucaaccucuccccucugcauaaucugcaaaaccucgaaguucuggaccuugggaccaauuuuaucaagauugcuaaccugagcauguucaaacaguuuaagcgccucaaagugaucgaucugucugugaauaagauuagccccuccggagacucuagcgaggucggcuucuguuccaacgccagaacaagcguggaaucuuaugagccgcagguucuggagcagcuucacuacuuucgguaugauaaguacgcgcgcuccugcagauucaaaaauaaggaagccagcuuuaugucugugaacgaguccugcuauaaauacgggcaaacccucgaccugagcaaaaauuccaucuucuuugucaagucuagcgauuuccagcaucuguccuuccucaagugucugaaccuuucuggaaaucugauuagccagacccucaacggcuccgaauuucagccucuggcugagcugcgguaccuugacuucagcaauaacagacucgaucugcugcacucuacagccuuugaagaacuccacaagcuggaggugcuugacaucuccagcaauucucauuauuuccaauccgaagggauuacgcacaugcugaacuuuaccaaaaaccucaagguucugcagaaacugaugaugaaugauaacgacaucagcucuagcacaucccgcaccauggagagcgaaucucuucggacacuggaguucagaggaaaucaucucgacgugcuguggcgcgaaggcgauaaccgguaccuccagcuguuuaagaaucuucugaaacucgaggagcuggacaucuccaagaacagccuguccuuccuucccucuggcgucuuugaugggaugccucccaaucugaagaaccucagccuggcuaaaaauggacucaaguccuucucuuggaaaaagcugcagugccuuaaaaaccuggaaacccucgaccugagccacaaucaacugacgacagugccugagagacuuuccaacuguucucgcagccugaagaaucucauucugaaaaacaaucagauccggucccucaccaaguauuuucugcaggaugccuuccagcuuagauaccuggaccugagcucuaacaagauucaaaugauccagaaaaccuccuuucccgaaaacguccucaauaaccugaagaugcuucugcuccaucacaaucgcuuccugugcacaugugaugccgugugguucguuuggugggugaaccacaccgaggucacaauuccguaucucgcuacggacgugaccugcguuggcccuggggcgcauaaaggacagagcgugaucucucuggaucuuuacacaugugagcuggaccugaccaaucucauccuguuuucccuuagcauuucugucucccuguuccucauggugaugaugacagccagccaccuguauuuuugggaugugugguacaucuaccauuucugcaaggcuaaaauuaagggcuaucaacggcucaucucccccgacuguugcuacgaugccuuuauuguuuaugacaccaaggaccccgccgucacggaaugggugcuggcugagcuuguggccaaacuggaagauccuagagagaagcacuucaaccugugucucgaggagcgcgacuggcugccggggcagcccguccuugagaaucugagccagucuauccagcucagcaaaaagaccguguuuguuaugacagauaaauacgcgaagaccgaaaacuucaagaucgcuuuuuaucugucccaccaacggcucauggacgagaaaguggaugucauuauccugauuuuccuugaaaagccuuuucagaaaucuaaguuccugcagcugagaaaacggcucugcggaagcuccgugcuggaguggcccacaaauccucaggcccaucccuacuucuggcaaugccuuaagaacgcccuggcuaccgacaaucacguugccuauucucagguguuuaaggaaacggucuga

SEQ ID NO: 9767 - protein, 1049 aa, Artificial Sequence [sequence omitted]

SEQ ID NO: 9768 - RNA, 3150 nt, Artificial Sequence
  TLR7__Homo_sapiens__AAZ99025
augguguuuccaauguggacacugaagagacuaauucuuauccuuuuuaacauaauccuaauuuccaaacuccuuggggcuagaugguuuccuaaaacucugcccugugaugucacucuggauguuccaaagaaccaugugaucguggacugcacagacaagcauuugacagaaauuccuggagguauucccacgaacaccacgaaccucacccucaccauuaaccacauaccagacaucuccccagcguccuuucacagacuggaccaucugguagagaucgauuucagaugcaacuguguaccuauuccacuggggucaaaaaacaacaugugcaucaagaggcugcagauuaaacccagaagcuuuaguggacucacuuauuuaaaaucccuuuaccuggauggaaaccagcuacuagagauaccgcagggccucccgccuagcuuacagcuucucagccuugaggccaacaacaucuuuuccaucagaaaagagaaucuaacagaacuggccaacauagaaauacucuaccugggccaaaacuguuauuaucgaaauccuuguuauguuucauauucaauagagaaagaugccuuccuaaacuugacaaaguuaaaagugcucucccugaaagauaacaaugucacagccgucccuacuguuuugccaucuacuuuaacagaacuauaucucuacaacaacaugauugcaaaaauccaagaagaugauuuuaauaaccucaaccaauuacaaauucuugaccuaaguggaaauugcccucguuguuauaaugccccauuuccuugugcgccguguaaaaauaauucuccccuacagaucccuguaaaugcuuuugaugcgcugacagaauuaaaaguuuuacgucuacacaguaacucucuucagcaugugcccccaagaugguuuaagaacaucaacaaacuccaggaacuggaucugucccaaaacuucuuggccaaagaaauuggggaugcuaaauuucugcauuuucuccccagccucauccaauuggaucugucuuucaauuuugaacuucaggucuaucgugcaucuaugaaucuaucacaagcauuuucuucacugaaaagccugaaaauucugcggaucagaggauaugucuuuaaagaguugaaaagcuuuaaccucucgccauuacauaaucuucaaaaucuugaaguucuugaucuuggcacuaacuuuauaaaaauugcuaaccucagcauguuuaaacaauuuaaaagacugaaagucauagaucuuucagugaauaaaauaucaccuucaggagauucaagugaaguuggcuucugcucaaaugucagaacuucuguagaaaguuaugaaccccagguccuggaacaauuacauuauuucagauaugauaaguaugcaaggaguugcagauucaaaaacaaagaggcuucuuucaugucuguuaaugaaagcugcuacaaguaugggcagaccuuggaucuaaguaaaaauaguauauuuuuugucaaguccucugauuuucagcaucuuucuuuccucaaaugccugaaucugucaggaaaucucauuagccaaacucuuaauggcagugaauuccaaccuuuagcagagcugagauauuuggacuucuccaacaaccggcuugauuuacuccauucaacagcauuugaagagcuucacaaacuggaaguucuggauauaagcaguaauagccauuauuuucaaucagaaggaauuacucauaugcuaaacuuuaccaagaaccuaaagguucugcagaaacugaugaugaacgacaaugacaucucuuccuccaccagcaggaccauggagagugagucucuuagaacucuggaauucagaggaaaucacuuagauguuuuauggagagaaggugauaacagauacuuacaauuauucaagaaucugcuaaaauuagaggaauuagacaucucuaaaaauucccuaaguuucuugccuucuggaguuuuugaugguaugccuccaaaucuaaagaaucucucuuuggccaaaaaugggcucaaaucuuucaguuggaagaaacuccagugucuaaagaaccuggaaacuuuggaccucagccacaaccaacugaccacugucccugagagauuauccaacuguuccagaagccucaagaaucugauucuuaagaauaaucaaaucaggagucugacgaaguauuuucuacaagaugccuuccaguugcgauaucuggaucucagcucaaauaaaauccagaugauccaaaagaccagcuucccagaaaauguccucaacaaucugaagauguugcuuuugcaucauaaucgguuucugugcaccugugaugcugugugguuugucugguggguuaaccauacggaggugacuauuccuuaccuggccacagaugugacuuguguggggccaggagcacacaagggccaaagugugaucucccuggaucuguacaccugugaguuagaucugacuaaccugauucuguucucacuuuccauaucuguaucucucuuucucauggugaugaugacagcaagucaccucuauuucugggaugugugguauauuuaccauuucuguaaggccaagauaaagggguaucagcgucuaauaucaccagacuguugcuaugaugcuuuuauuguguaugacacuaaagacccagcugugaccgaguggguuuuggcugagcugguggccaaacuggaagacccaagagagaaacauuuuaauuuaugucucgaggaaagggacugguuaccagggcagccaguucuggaaaaccuuucccagagcauacagcuuagcaaaaagacaguguuugugaugacagacaaguaugcaaagacugaaaauuuuaagauagcauuuuacuugucccaucagaggcucauggaugaaaaaguugaugugauuaucuugauauuucuugagaagcccuuucagaaguccaaguuccuccagcuccggaaaaggcucugugggaguucuguccuugaguggccaacaaacccgcaagcucacccauacuucuggcagugucuaaagaacgcccuggccacagacaaucauguggccuauagucagguguucaaggaaacggucuag

SEQ ID NO: 9769 - RNA, 3150 nt, Artificial Sequence
  derived and/or modified sequence opt1 from TLR7__Homo_sapiens__AAZ99025
augguguuccccauguggacccugaagcgccucauccugauccuguucaacaucauccucaucagcaagcugcugggcgcccggugguucccgaagacccuccccugcgacgucacgcuggacgugcccaagaaccacgugaucgucgacugcaccgacaagcaccugaccgagauccccgggggcaucccgaccaacacgaccaaccucacccugaccaucaaccacauccccgacaucucccccgccagcuuccaccgccuggaccaccucguggagaucgacuuccggugcaacugcgugcccaucccgcugggguccaagaacaacaugugcaucaagcgccugcagaucaagccccggagcuucuccggccucacguaccucaagagccuguaccucgacgggaaccagcugcuggagaucccccagggccugcccccgucccugcagcugcucagccuggaggcgaacaacaucuucuccauccgcaaggagaaccugaccgagcucgccaacaucgagauccuguaccugggccagaacugcuacuaccggaaccccugcuacgucagcuacuccaucgagaaggacgccuuccucaaccugaccaagcugaaggugcucagccugaaggacaacaacgugaccgccguccccacggugcugcccuccacccucaccgagcuguaccuguacaacaacaugaucgccaagauccaggaggacgacuucaacaaccucaaccagcugcagauccuggaccucagcgggaacugcccgcgcugcuacaacgcgcccuuccccugcgcccccugcaagaacaacuccccgcugcagauccccgugaacgccuucgacgcccugaccgagcucaagguccugcggcugcacagcaacucccuccagcacgugccgccccgcugguucaagaacaucaacaagcugcaggagcuggaccugagccagaacuuccucgcgaaggagaucggcgacgccaaguuccugcacuuccugcccucccucauccagcuggaccugagcuucaacuucgagcuccagguguaccgggccagcaugaaccugucccaggccuucagcucccucaagagccugaagauccugcgcauccggggguacgucuucaaggagcugaaguccuucaaccucagcccccugcacaaccugcagaaccucgaggugcuggaccugggcacgaacuucaucaagaucgccaaccucuccauguucaagcaguucaagcgccugaaggugaucgaccugagcgucaacaagaucucccccagcggggacuccagcgaggugggcuucugcuccaacgugcggaccagcgucgaguccuacgagccccaggugcucgagcagcugcacuacuuccgcuacgacaaguacgcgcggagcugccgcuucaagaacaaggaggccuccuucaugagcgugaacgaguccugcuacaaguacggccagacccuggaccucagcaagaacagcaucuucuucgucaaguccagcgacuuccagcaccuguccuuccugaagugccucaaccugagcgggaaccugaucucccagacccucaacggcagcgaguuccagccgcuggccgagcugcgguaccucgacuucuccaacaaccgccuggaccugcuccacagcacggccuucgaggagcugcacaagcuggaggugcucgacaucuccagcaacucccacuacuuccagagcgaggggaucacccacaugcugaacuucaccaagaaccugaagguccuccagaagcugaugaugaacgacaacgacaucuccagcuccaccagccggacgauggaguccgagagccugcgcacccucgaguuccgcggcaaccaccuggacgugcuguggcgggagggcgacaaccgcuaccuccagcuguucaagaaccugcucaagcuggaggagcuggacaucagcaagaacucccucagcuuccugcccuccgggguguucgacggcaugcccccgaaccugaagaaccucagccuggccaagaacgggcugaaguccuucagcuggaagaagcuccagugccugaagaaccuggagacccucgaccugucccacaaccagcugaccacgguccccgagcggcucagcaacugcucccgcagccugaagaaccugauccucaagaacaaccagauccggucccugaccaaguacuuccugcaggacgcguuccagcuccgcuaccuggaccugagcuccaacaagauccagaugauccagaagaccagcuuccccgagaacgugcucaacaaccugaagaugcugcuccugcaccacaaccgguuccugugcacgugcgacgccgugugguucgucuggugggugaaccacaccgaggugaccauccccuaccucgccaccgacgugaccugcgucggcccgggggcccacaagggccaguccgugaucagccuggaccuguacacgugcgagcucgaccugaccaaccugauccucuucucccugagcaucuccgucagccuguuccucauggugaugaugaccgccagccaccuguacuucugggacgugugguacaucuaccacuucugcaaggcgaagaucaagggcuaccagcgccugaucucccccgacugcugcuacgacgccuucaucgucuacgacaccaaggaccccgccgugaccgagugggugcucgccgagcuggucgccaagcuggaggacccccgggagaagcacuucaaccugugccucgaggagcgcgacuggcugccggggcagcccgugcuggagaaccucagccaguccauccagcugagcaagaagacgguguucgucaugaccgacaaguacgcgaagaccgagaacuucaagaucgccuucuaccugucccaccagcggcucauggacgagaagguggacgugaucauccugaucuuccuggagaagcccuuccagaaguccaaguuccuccagcugcgcaagcggcugugcggcagcagcguccucgaguggcccaccaacccgcaggcccaccccuacuucuggcagugccugaagaacgcccuggcgacggacaaccacguggccuacucccagguguucaaggagaccgucuga

SEQ ID NO: 9770 - RNA, 3150 nt, Artificial Sequence
  derived and/or modified sequence opt2 from TLR7__Homo_sapiens__AAZ99025
auggucuuccccauguggacccucaagcgccucauccucauccucuucaacaucauccucaucuccaagcuccucggcgcccgcugguuccccaagacccuccccugcgacgucacccucgacguccccaagaaccacgucaucgucgacugcaccgacaagcaccucaccgagauccccggcggcauccccaccaacaccaccaaccucacccucaccaucaaccacauccccgacaucucccccgccuccuuccaccgccucgaccaccucgucgagaucgacuuccgcugcaacugcguccccaucccccucggcuccaagaacaacaugugcaucaagcgccuccagaucaagccccgcuccuucuccggccucaccuaccucaagucccucuaccucgacggcaaccagcuccucgagaucccccagggccucccccccucccuccagcuccucucccucgaggccaacaacaucuucuccauccgcaaggagaaccucaccgagcucgccaacaucgagauccucuaccucggccagaacugcuacuaccgcaaccccugcuacgucuccuacuccaucgagaaggacgccuuccucaaccucaccaagcucaagguccucucccucaaggacaacaacgucaccgccguccccaccguccuccccuccacccucaccgagcucuaccucuacaacaacaugaucgccaagauccaggaggacgacuucaacaaccucaaccagcuccagauccucgaccucuccggcaacugcccccgcugcuacaacgcccccuuccccugcgcccccugcaagaacaacuccccccuccagauccccgucaacgccuucgacgcccucaccgagcucaagguccuccgccuccacuccaacucccuccagcacguccccccccgcugguucaagaacaucaacaagcuccaggagcucgaccucucccagaacuuccucgccaaggagaucggcgacgccaaguuccuccacuuccuccccucccucauccagcucgaccucuccuucaacuucgagcuccaggucuaccgcgccuccaugaaccucucccaggccuucuccucccucaagucccucaagauccuccgcauccgcggcuacgucuucaaggagcucaaguccuucaaccucuccccccuccacaaccuccagaaccucgagguccucgaccucggcaccaacuucaucaagaucgccaaccucuccauguucaagcaguucaagcgccucaaggucaucgaccucuccgucaacaagaucucccccuccggcgacuccuccgaggucggcuucugcuccaacguccgcaccuccgucgaguccuacgagccccagguccucgagcagcuccacuacuuccgcuacgacaaguacgcccgcuccugccgcuucaagaacaaggaggccuccuucauguccgucaacgaguccugcuacaaguacggccagacccucgaccucuccaagaacuccaucuucuucgucaaguccuccgacuuccagcaccucuccuuccucaagugccucaaccucuccggcaaccucaucucccagacccucaacggcuccgaguuccagccccucgccgagcuccgcuaccucgacuucuccaacaaccgccucgaccuccuccacuccaccgccuucgaggagcuccacaagcucgagguccucgacaucuccuccaacucccacuacuuccaguccgagggcaucacccacaugcucaacuucaccaagaaccucaagguccuccagaagcucaugaugaacgacaacgacaucuccuccuccaccucccgcaccauggaguccgagucccuccgcacccucgaguuccgcggcaaccaccucgacguccucuggcgcgagggcgacaaccgcuaccuccagcucuucaagaaccuccucaagcucgaggagcucgacaucuccaagaacucccucuccuuccuccccuccggcgucuucgacggcaugccccccaaccucaagaaccucucccucgccaagaacggccucaaguccuucuccuggaagaagcuccagugccucaagaaccucgagacccucgaccucucccacaaccagcucaccaccguccccgagcgccucuccaacugcucccgcucccucaagaaccucauccucaagaacaaccagauccgcucccucaccaaguacuuccuccaggacgccuuccagcuccgcuaccucgaccucuccuccaacaagauccagaugauccagaagaccuccuuccccgagaacguccucaacaaccucaagaugcuccuccuccaccacaaccgcuuccucugcaccugcgacgccgucugguucgucuggugggucaaccacaccgaggucaccauccccuaccucgccaccgacgucaccugcgucggccccggcgcccacaagggccaguccgucaucucccucgaccucuacaccugcgagcucgaccucaccaaccucauccucuucucccucuccaucuccgucucccucuuccucauggucaugaugaccgccucccaccucuacuucugggacgucugguacaucuaccacuucugcaaggccaagaucaagggcuaccagcgccucaucucccccgacugcugcuacgacgccuucaucgucuacgacaccaaggaccccgccgucaccgaguggguccucgccgagcucgucgccaagcucgaggacccccgcgagaagcacuucaaccucugccucgaggagcgcgacuggcuccccggccagcccguccucgagaaccucucccaguccauccagcucuccaagaagaccgucuucgucaugaccgacaaguacgccaagaccgagaacuucaagaucgccuucuaccucucccaccagcgccucauggacgagaaggucgacgucaucauccucaucuuccucgagaagcccuuccagaaguccaaguuccuccagcuccgcaagcgccucugcggcuccuccguccucgaguggcccaccaacccccaggcccaccccuacuucuggcagugccucaagaacgcccucgccaccgacaaccacgucgccuacucccaggucuucaaggagaccgucuga

SEQ ID NO: 9771 - RNA, 3150 nt, Artificial Sequence
  derived and/or modified sequence opt3 from TLR7__Homo_sapiens__AAZ99025
augguguuccccauguggacccugaagagacucauccuuauucuguuuaacauaaucuugauuagcaaauuacugggcgccaggugguucccuaagacacuaccaugcgacgucacucucgauguuccgaaaaaucacgugaucguagacuguacggauaagcaucugaccgagauucccgggggaaucccuacaaacacuaccaaucuuacacugaccauaaaccacaucccagacauuucccccgcuucuuuucaucgguuggaucaccucguggaaaucgacuuccgcugcaauugugucccuauuccacuggguagcaaaaacaauaugugcaucaagcgacugcagauaaagccccguaguuuuagcggccucacuuacuuaaaaucccuguaucuugaugggaaccaauugcuggagauuccucagggacuaccaccgucucuccagcugcuuucgcuggaagcaaauaacaucuucucaauuagaaaggagaauuugacagaacucgccaacaucgagauccuguacuuaggccagaauuguuauuacaggaaccccugcuaugugagcuacaguauugagaaagacgcguuucugaaucucaccaaacuuaaaguucuguccuugaaggauaacaacgugacggcugucccuacugugcuaccaucuacccugacagaacucuaucuguacaauaacaugauagccaagauccaagaggacgauuucaauaaccuuaaucagcugcagauuuuggaccucagcgguaacuguccccggugcuacaaugcaccuuuuccaugugcccccugcaaaaacaauuccccgcugcagaucccuguaaacgcuuucgaugcauuaacugaacugaagguucuacgccuccauucaaauagucugcaacacgugcccccaagaugguuuaaaaacauaaauaaacuucaggaguuggaccugagccagaacuuccucgccaaagagauuggggacgcuaaguuucugcacuuccuuccuucucugauccaguuggaucucuccuucaauuuugaacugcaagucuauagggccucaaugaacuuaagccaggcguucaguucucugaaaucccuaaagauccuccggauucgcggauacguguuuaaggagcugaaaucauucaaccuuucgcccuugcauaaucugcagaaccucgaagugcuggacuuaggcaccaauuuuaucaagauugcaaaccugucuauguucaaacaauuuaagcgacuuaaagucauagauuuguccguuaauaagaucucaccaaguggcgacagcuccgaggugggguucuguucuaacguaagaacaagcguggaaucauaugagccccagguccucgagcagcugcacuacuuuagguaugauaaguacgcccggaguugccguuucaaaaauaaggaggcuuccuuuaugagcgugaacgaaucuugcuauaaauacggacagacccuagaccugucaaagaauaguauuuucuuuguuaaaagcuccgauuuccaacaucucucuuuccugaagugucuuaacuugucggguaaucugaucagccagacguuaaacggcuccgaauuucagccucucgccgagcugcgcuaccuugacuucucaaauaacagacuggauuugcuccacaguacugcauuugaggaacugcacaagcuagaggugcuggacaucucuagcaauucccauuauuuccagucagaagggauuacacacaugcucaacuuuaccaaaaaccugaagguccuucaaaaauugaugaugaaugauaacgacauaaguucuuccacuagcaggacaauggagagcgaaucucugcggaccuuagaguuccgaggaaaucaucucgacgugcuguggcgcgaaggcgauaacagauaccuucagcuguuuaagaaucuacucaaacuggaggaguuggacaucuccaagaacucacugaguuucuuaccaagcgguguauuugaugggaugccgcccaaucucaagaaccugucgcuugcuaaaaauggacugaaguccuucucuuggaaaaaguugcagugccucaaaaaccuggaaacgcuagaccugagccacaaucagcuuaccacaguuccugagaggcucucaaacuguagucggucccugaagaauuugauucugaaaaacaaucaaauccgcucuuuaacuaaguauuuucuccaggaugccuuccagcugagauaccuugaccugagcuccaacaagauucagaugauccaaaagaccucauuuccagaaaacguguugaauaaccucaagaugcugcuacugcaucacaauagguuccuuugcacaugugaugcggucugguucguguggugggucaaccacacugaggugaccauacccuaucucgccacagacguuaccugcgugggcccuggcgcacauaaagggcagagcguaaucagucuggauuuguacacuugugaguuagaccugacgaaucucauucuguuuucucuuuccaucagcgucucgcuguucuugauggugaugaugacagcuucacaccuauauuuuugggauguuugguacauuuaccauuucugcaaggccaaaaucaagggauaucagcgucugauaucuccagacuguugcuacgaugcuuuuauuguguaugacaccaaggaccccgccgucacugaaugggugcucgcagagcugguagccaaacuugaagauccgcgggagaagcacuucaacuuaugucuggaggaacgagacuggcucccuggucaaccaguguuggagaaucugagucaguccauccagcucagcaaaaagaccguuuuugucaugacagauaaauacgcuaagaccgaaaacuucaagauugcguuuuaucugucucaccagagacuuauggacgagaaaguggaugugaucauacugaucuucuuggaaaagcccuuucaaaagagcaaguuccuacagcugaggaaacgccucugcggcuccucagucuuagaguggccuacuaauccccaggcacauccauacuucuggcagugccugaagaacgcccuugcuacagacaaucacguugccuauagucaaguguuuaaggaaacgguguga

SEQ ID NO: 9772 - RNA, 3150 nt, Artificial Sequence
  derived and/or modified sequence opt4 from TLR7__Homo_sapiens__AAZ99025
augguguuccccauguggacccugaagagacugauccugauccuguucaacaucauccugaucagcaagcugcugggcgccagaugguuccccaagacccugcccugcgacgugacccuggacgugcccaagaaccacgugaucguggacugcaccgacaagcaccugaccgagauccccggcggcauccccaccaacaccaccaaccugacccugaccaucaaccacauccccgacaucagccccgccagcuuccacagacuggaccaccugguggagaucgacuucagaugcaacugcgugcccaucccccugggcagcaagaacaacaugugcaucaagagacugcagaucaagcccagaagcuucagcggccugaccuaccugaagagccuguaccuggacggcaaccagcugcuggagaucccccagggccugccccccagccugcagcugcugagccuggaggccaacaacaucuucagcaucagaaaggagaaccugaccgagcuggccaacaucgagauccuguaccugggccagaacugcuacuacagaaaccccugcuacgugagcuacagcaucgagaaggacgccuuccugaaccugaccaagcugaaggugcugagccugaaggacaacaacgugaccgccgugcccaccgugcugcccagcacccugaccgagcuguaccuguacaacaacaugaucgccaagauccaggaggacgacuucaacaaccugaaccagcugcagauccuggaccugagcggcaacugccccagaugcuacaacgcccccuuccccugcgcccccugcaagaacaacagcccccugcagauccccgugaacgccuucgacgcccugaccgagcugaaggugcugagacugcacagcaacagccugcagcacgugccccccagaugguucaagaacaucaacaagcugcaggagcuggaccugagccagaacuuccuggccaaggagaucggcgacgccaaguuccugcacuuccugcccagccugauccagcuggaccugagcuucaacuucgagcugcagguguacagagccagcaugaaccugagccaggccuucagcagccugaagagccugaagauccugagaaucagaggcuacguguucaaggagcugaagagcuucaaccugagcccccugcacaaccugcagaaccuggaggugcuggaccugggcaccaacuucaucaagaucgccaaccugagcauguucaagcaguucaagagacugaaggugaucgaccugagcgugaacaagaucagccccagcggcgacagcagcgaggugggcuucugcagcaacgugagaaccagcguggagagcuacgagccccaggugcuggagcagcugcacuacuucagauacgacaaguacgccagaagcugcagauucaagaacaaggaggccagcuucaugagcgugaacgagagcugcuacaaguacggccagacccuggaccugagcaagaacagcaucuucuucgugaagagcagcgacuuccagcaccugagcuuccugaagugccugaaccugagcggcaaccugaucagccagacccugaacggcagcgaguuccagccccuggccgagcugagauaccuggacuucagcaacaacagacuggaccugcugcacagcaccgccuucgaggagcugcacaagcuggaggugcuggacaucagcagcaacagccacuacuuccagagcgagggcaucacccacaugcugaacuucaccaagaaccugaaggugcugcagaagcugaugaugaacgacaacgacaucagcagcagcaccagcagaaccauggagagcgagagccugagaacccuggaguucagaggcaaccaccuggacgugcuguggagagagggcgacaacagauaccugcagcuguucaagaaccugcugaagcuggaggagcuggacaucagcaagaacagccugagcuuccugcccagcggcguguucgacggcaugccccccaaccugaagaaccugagccuggccaagaacggccugaagagcuucagcuggaagaagcugcagugccugaagaaccuggagacccuggaccugagccacaaccagcugaccaccgugcccgagagacugagcaacugcagcagaagccugaagaaccugauccugaagaacaaccagaucagaagccugaccaaguacuuccugcaggacgccuuccagcugagauaccuggaccugagcagcaacaagauccagaugauccagaagaccagcuuccccgagaacgugcugaacaaccugaagaugcugcugcugcaccacaacagauuccugugcaccugcgacgccgugugguucguguggugggugaaccacaccgaggugaccauccccuaccuggccaccgacgugaccugcgugggccccggcgcccacaagggccagagcgugaucagccuggaccuguacaccugcgagcuggaccugaccaaccugauccuguucagccugagcaucagcgugagccuguuccugauggugaugaugaccgccagccaccuguacuucugggacgugugguacaucuaccacuucugcaaggccaagaucaagggcuaccagagacugaucagccccgacugcugcuacgacgccuucaucguguacgacaccaaggaccccgccgugaccgagugggugcuggccgagcugguggccaagcuggaggaccccagagagaagcacuucaaccugugccuggaggagagagacuggcugcccggccagcccgugcuggagaaccugagccagagcauccagcugagcaagaagaccguguucgugaugaccgacaaguacgccaagaccgagaacuucaagaucgccuucuaccugagccaccagagacugauggacgagaagguggacgugaucauccugaucuuccuggagaagcccuuccagaagagcaaguuccugcagcugagaaagagacugugcggcagcagcgugcuggaguggcccaccaacccccaggcccaccccuacuucuggcagugccugaagaacgcccuggccaccgacaaccacguggccuacagccagguguucaaggagaccguguga

SEQ ID NO: 9773 - RNA, 3150 nt, Artificial Sequence
  derived and/or modified sequence opt5 from TLR7__Homo_sapiens__AAZ99025
augguguuccccauguggacccugaagagacucauccugauucuuuuuaacaucauucugaucagcaaacuccugggcgcccggugguucccuaagacacuuccgugcgacgucacgcuggauguucccaaaaaucacgugauuguggacuguaccgauaagcaucucacagagaucccugggggaauccccaccaacacaaccaaucugacacugaccauuaaccacaucccugacauuucccccgcuucuuuucaucgccucgaucaccuggucgaaaucgacuucagaugcaauugugugccuauuccgcuuggcagcaaaaacaauaugugcaucaagcggcugcagauuaagccccgcuccuuuucugggcucacguaccugaaaagccuuuaucuggauggaaaccaacuccuggagaucccucagggccugcccccuucccuccagcugcuuucucuggaagccaauaacaucuucagcauuagaaaggagaaucucaccgaacuggcgaacaucgagauucuuuaccuggggcagaauuguuauuaccggaaccccugcuauguuuccuacagcaucgagaaagacgcuuuucucaaucugacaaagcugaaagugcucucucugaaggauaacaacgucaccgccgugccgacaguucuuccuuccacccugacggaacucuaucuguacaauaacaugauugccaagauccaagaggacgauuucaauaaccuuaaucagcugcagauccucgaccugagcggaaacuguccccgcugcuacaaugcuccuuuucccugugcccccugcaaaaacaauucuccucugcagauuccggugaacgcuuucgaugcccucacagaacugaagguccuuagacugcauuccaauagccuccaacacgugcccccucggugguuuaaaaacaucaauaagcugcaggagcuggaccuuucucagaacuuccucgcgaaagagauuggcgacgccaaguuucugcacuuccugcccucccucauccagcuggaucuuagcuucaauuuugaacugcaaguguaucgcgcuuccaugaaccucucucaggccuucagcucccugaaaagccugaagauucuuagaauccggggcuacgucuuuaaggagcucaaaucuuucaaccuguccccucugcauaaucuccagaaccuggaaguucuugaccuggggaccaauuuuaucaagauugcuaaccucagcauguucaaacaauuuaagcgccugaaagugaucgaucugucugugaauaagauuagccccuccggagacucuagcgaggucggcuucuguuccaacgugagaacaagcguugaaucuuaugagccucaggugcuugagcagcuccacuacuuucgguaugauaaguacgcccgcuccugcagauucaaaaauaaggaagcgagcuuuaugucugucaacgaguccugcuauaaauacgggcagacccuggaccugagcaaaaauuccaucuucuuugugaaaucuagcgauuuccaacaucucuccuuccugaagugucuuaaccugucuggaaaucucauuagccagacccugaacggcuccgaauuucagccgcuggccgagcuucgguaccucgacuucagcaauaacagacuggaucugcuccacucuacagcuuuugaagaacugcacaaacuugagguucuggacaucuccagcaauucucauuauuuccaguccgaagggauuacgcacaugcucaacuuuaccaagaaccugaaggugcugcaaaaacuuaugaugaaugauaacgacaucagcucuagcacaucccgcaccauggagagcgaaucucugcggacacucgaguucagaggaaaucaucuggacguccucuggcgcgaaggcgauaaccgguaccugcagcuuuuuaagaaucugcucaaacuggaggagcuggacaucuccaagaacagccuuuccuuccugcccucuggcguguuugaugggaugccucccaaucucaagaaccugagccucgccaaaaauggacugaaguccuucucuuggaaaaagcugcagugccuuaaaaaccucgaaacccuggaccugagccacaaucagcuuacgacagucccugagagacuguccaacuguucucgcagccucaagaaucugauucucaaaaacaaucaaauccggucccugaccaaguauuuucuucaggaugcuuuccagcugagauaccuggaccucagcucuaacaagauucagaugauccaaaagaccuccuuucccgaaaacgugcugaauaaccuuaagaugcugcuccugcaucacaaucgcuuccucugcacaugugaugccguuugguucguguggugggucaaccacaccgaggugacaauuccguaucuggccacggacguuaccugcgugggcccuggggcucauaaaggacagagcgucaucucucuugaucuguacacaugugagcuggaccucaccaaucugauccuguuuucccuuagcauuucugugucccucuuccugauggugaugaugacagcgagccaccucuauuuuugggauguuugguacaucuaccauuucugcaaggccaaaauuaagggcuaucagcggcugaucucccccgacuguugcuacgaugcuuuuauugucuaugacaccaaggaccccgccgugacggaaugggugcuugccgagcuggucgcuaaacuggaagauccuagagagaagcacuucaaccucugucuggaggagcgcgacuggcuuccggggcaacccgugcuggagaaucucagccagucuauccagcugagcaaaaagaccguuuuugugaugacagauaaauacgccaagaccgaaaacuucaagaucgcguuuuaucucucccaccagcggcugauggacgagaaagucgaugugauuauccuuauuuuccuggaaaagccuuuucaaaaaucuaaguuccugcagcucagaaaacggcugugcggaagcuccguucuugaguggcccacaaauccucaggcucaucccuacuucuggcagugccugaagaacgcccucgccaccgacaaucacguggcuuauucucaagucuuuaaggaaacgguguga

SEQ ID NO: 9774 - protein, 1049 aa, Artificial Sequence; identical to SEQ ID NO: 9760
  TLR7__Homo_sapiens__Q9NYK1

SEQ ID NO: 9775 - RNA, 3150 nt, Artificial Sequence
  TLR7__Homo_sapiens__AAF60188
augguguuuccaauguggacacugaagagacaaauucuuauccuuuuuaacauaauccuaauuuccaaacuccuuggggcuagaugguuuccuaaaacucugcccugugaugucacucuggauguuccaaagaaccaugugaucguggacugcacagacaagcauuugacagaaauuccuggagguauucccacgaacaccacgaaccucacccucaccauuaaccacauaccagacaucuccccagcguccuuucacagacuggaccaucugguagagaucgauuucagaugcaacuguguaccuauuccacuggggucaaaaaacaacaugugcaucaagaggcugcagauuaaacccagaagcuuuaguggacucacuuauuuaaaaucccuuuaccuggauggaaaccagcuacuagagauaccgcagggccucccgccuagcuuacagcuucucagccuugaggccaacaacaucuuuuccaucagaaaagagaaucuaacagaacuggccaacauagaaauacucuaccugggccaaaacuguuauuaucgaaauccuuguuauguuucauauucaauagagaaagaugccuuccuaaacuugacaaaguuaaaagugcucucccugaaagauaacaaugucacagccgucccuacuguuuugccaucuacuuuaacagaacuauaucucuacaacaacaugauugcaaaaauccaagaagaugauuuuaauaaccucaaccaauuacaaauucuugaccuaaguggaaauugcccucguuguuauaaugccccauuuccuugugcgccguguaaaaauaauucuccccuacagaucccuguaaaugcuuuugaugcgcugacagaauuaaaaguuuuacgucuacacaguaacucucuucagcaugugcccccaagaugguuuaagaacaucaacaaacuccaggaacuggaucugucccaaaacuucuuggccaaagaaauuggggaugcuaaauuucugcauuuucuccccagccucauccaauuggaucugucuuucaauuuugaacuucaggucuaucgugcaucuaugaaucuaucacaagcauuuucuucacugaaaagccugaaaauucugcggaucagaggauaugucuuuaaagaguugaaaagcuuuaaccucucgccauuacauaaucuucaaaaucuugaaguucuugaucuuggcacuaacuuuauaaaaauugcuaaccucagcauguuuaaacaauuuaaaagacugaaagucauagaucuuucagugaauaaaauaucaccuucaggagauucaagugaaguuggcuucugcucaaaugccagaacuucuguagaaaguuaugaaccccagguccuggaacaauuacauuauuucagauaugauaaguaugcaaggaguugcagauucaaaaacaaagaggcuucuuucaugucuguuaaugaaagcugcuacaaguaugggcagaccuuggaucuaaguaaaaauaguauauuuuuugucaaguccucugauuuucagcaucuuucuuuccucaaaugccugaaucugucaggaaaucucauuagccaaacucuuaauggcagugaauuccaaccuuuagcagagcugagauauuuggacuucuccaacaaccggcuugauuuacuccauucaacagcauuugaagagcuucacaaacuggaaguucuggauauaagcaguaauagccauuauuuucaaucagaaggaauuacucauaugcuaaacuuuaccaagaaccuaaagguucugcagaaacugaugaugaacgacaaugacaucucuuccuccaccagcaggaccauggagagugagucucuuagaacucuggaauucagaggaaaucacuuagauguuuuauggagagaaggugauaacagauacuuacaauuauucaagaaucugcuaaaauuagaggaauuagacaucucuaaaaauucccuaaguuucuugccuucuggaguuuuugaugguaugccuccaaaucuaaagaaucucucuuuggccaaaaaugggcucaaaucuuucaguuggaagaaacuccagugucuaaagaaccuggaaacuuuggaccucagccacaaccaacugaccacugucccugagagauuauccaacuguuccagaagccucaagaaucugauucuuaagaauaaucaaaucaggagucugacgaaguauuuucuacaagaugccuuccaguugcgauaucuggaucucagcucaaauaaaauccagaugauccaaaagaccagcuucccagaaaauguccucaacaaucugaagauguugcuuuugcaucauaaucgguuucugugcaccugugaugcugugugguuugucugguggguuaaccauacggaggugacuauuccuuaccuggccacagaugugacuuguguggggccaggagcacacaagggccaaagugugaucucccuggaucuguacaccugugaguuagaucugacuaaccugauucuguucucacuuuccauaucuguaucucucuuucucauggugaugaugacagcaagucaccucuauuucugggaugugugguauauuuaccauuucuguaaggccaagauaaagggguaucagcgucuaauaucaccagacuguugcuaugaugcuuuuauuguguaugacacuaaagacccagcugugaccgaguggguuuuggcugagcugguggccaaacuggaagacccaagagagaaacauuuuaauuuaugucucgaggaaagggacugguuaccagggcagccaguucuggaaaaccuuucccagagcauacagcuuagcaaaaagacaguguuugugaugacagacaaguaugcaaagacugaaaauuuuaagauagcauuuuacuugucccaucagaggcucauggaugaaaaaguugaugugauuaucuugauauuucuugagaagcccuuucagaaguccaaguuccuccagcuccggaaaaggcucugugggaguucuguccuugaguggccaacaaacccgcaagcucacccauacuucuggcagugucuaaagaacgcccuggccacagacaaucauguggccuauagucagguguucaaggaaacggucuag

SEQ ID NO: 9776 - RNA, 3150 nt, Artificial Sequence; identical to SEQ ID NO: 9762
  derived and/or modified sequence opt1 from TLR7__Homo_sapiens__AAF60188

SEQ ID NO: 9777 - RNA, 3150 nt, Artificial Sequence; identical to SEQ ID NO: 9763
  derived and/or modified sequence opt2 from TLR7__Homo_sapiens__AAF60188

SEQ ID NO: 9778 - RNA, 3150 nt, Artificial Sequence; identical to SEQ ID NO: 9764
  derived and/or modified sequence opt3 from TLR7__Homo_sapiens__AAF60188

SEQ ID NO: 9779 - RNA, 3150 nt, Artificial Sequence; identical to SEQ ID NO: 9765
  derived and/or modified sequence opt4 from TLR7__Homo_sapiens__AAF60188

SEQ ID NO: 9780 - RNA, 3150 nt, Artificial Sequence; identical to SEQ ID NO: 9766
  derived and/or modified sequence opt5 from TLR7__Homo_sapiens__AAF60188

SEQ ID NO: 9781 - protein, 1041 aa, Artificial Sequence [sequence omitted]

SEQ ID NO: 9782 - RNA, 3126 nt, Artificial Sequence
  TLR8__Homo_sapiens__AAI01076
auggaaaacauguuccuucagucgucaaugcugaccugcauuuuccugcuaauaucugguuccugugaguuaugcgccgaagaaaauuuuucuagaagcuauccuugugaugagaaaaagcaaaaugacucaguuauugcagagugcagcaaucgucgacuacaggaaguuccccaaacggugggcaaauaugugacagaacuagaccugucugauaauuucaucacacacauaacgaaugaaucauuucaagggcugcaaaaucucacuaaaauaaaucuaaaccacaaccccaauguacagcaccagaacggaaaucccgguauacaaucaaauggcuugaauaucacagacggggcauuccucaaccuaaaaaaccuaagggaguuacugcuugaagacaaccaguuaccccaaauacccucugguuugccagagucuuugacagaacuuagucuaauucaaaacaauauauacaacauaacuaaagagggcauuucaagacuuauaaacuugaaaaaucucuauuuggccuggaacugcuauuuuaacaaaguuugcgagaaaacuaacauagaagauggaguauuugaaacgcugacaaauuuggaguugcuaucacuaucuuucaauucucuuucacacgugccacccaaacugccaagcucccuacgcaaacuuuuucugagcaacacccagaucaaauacauuagugaagaagauuucaagggauugauaaauuuaacauuacuagauuuaagcgggaacuguccgaggugcuucaaugccccauuuccaugcgugccuugugaugguggugcuucaauuaauauagaucguuuugcuuuucaaaacuugacccaacuucgauaccuaaaccucucuagcacuucccucaggaagauuaaugcugccugguuuaaaaauaugccucaucugaaggugcuggaucuugaauucaacuauuuagugggagaaauagccucuggggcauuuuuaacgaugcugccccgcuuagaaauacuugacuugucuuuuaacuauauaaaggggaguuauccacagcauauuaauauuuccagaaacuucucuaaacuuuugucucuacgggcauugcauuuaagagguuauguguuccaggaacucagagaagaugauuuccagccccugaugcagcuuccaaacuuaucgacuaucaacuuggguauuaauuuuauuaagcaaaucgauuucaaacuuuuccaaaauuucuccaaucuggaaauuauuuacuugucagaaaacagaauaucaccguugguaaaagauacccggcagaguuaugcaaauaguuccucuuuucaacgucauauccggaaacgacgcucaacagauuuugaguuugacccacauucgaacuuuuaucauuucacccguccuuuaauaaagccacaaugugcugcuuauggaaaagccuuagauuuaagccucaacaguauuuucuucauugggccaaaccaauuugaaaaucuuccugacauugccuguuuaaaucugucugcaaauagcaaugcucaaguguuaaguggaacugaauuuucagccauuccucaugucaaauauuuggauuugacaaacaauagacuagacuuugauaaugcuagugcucuuacugaauuguccgacuuggaaguucuagaucucagcuauaauucacacuauuucagaauagcaggcguaacacaucaucuagaauuuauucaaaauuucacaaaucuaaaaguuuuaaacuugagccacaacaacauuuauacuuuaacagauaaguauaaccuggaaagcaagucccugguagaauuaguuuucaguggcaaucgccuugacauuuuguggaaugaugaugacaacagguauaucuccauuuucaaaggucucaagaaucugacacgucuggauuuaucccuuaauaggcugaagcacaucccaaaugaagcauuccuuaauuugccagcgagucucacugaacuacauauaaaugauaauauguuaaaguuuuuuaacuggacauuacuccagcaguuuccucgucucgaguugcuugacuuacguggaaacaaacuacucuuuuuaacugauagccuaucugacuuuacaucuucccuucggacacugcugcugagucauaacaggauuucccaccuacccucuggcuuucuuucugaagucaguagucugaagcaccucgauuuaaguuccaaucugcuaaaaacaaucaacaaauccgcacuugaaacuaagaccaccaccaaauuaucuauguuggaacuacacggaaaccccuuugaaugcaccugugacauuggagauuuccgaagauggauggaugaacaucugaaugucaaaauucccagacugguagaugucauuugugccaguccuggggaucaaagagggaagaguauugugagucuggagcuaacaacuuguguuucagaugucacugcagugauauuauuuuucuucacguucuuuaucaccaccaugguuauguuggcugcccuggcucaccauuuguuuuacugggauguuugguuuauauauaauguguguuuagcuaagguaaaaggcuacaggucucuuuccacaucccaaacuuucuaugaugcuuacguuucuuaugacaccaaagaugccucuguuacugacugggugauaaaugagcugcgcuaccaccuugaagagagccgagacaaaaacguucuccuuugucuagaggagagggauugggacccgggauuggccaucaucgacaaccucaugcagagcaucaaccaaagcaagaaaacaguauuuguuuuaaccaaaaaauaugcaaaaagcuggaacuuuaaaacagcuuuuuacuuggcuuugcagaggcuaauggaugagaacauggaugugauuauauuuauccugcuggagccaguguuacagcauucucaguauuugaggcuacggcagcggaucuguaagagcuccauccuccaguggccugacaacccgaaggcagaaggcuuguuuuggcaaacucugagaaauguggucuugacugaaaaugauucacgguauaacaauauguaugucgauuccauuaagcaauacuaa

SEQ ID NO: 9783 - RNA, 3126 nt, Artificial Sequence
  derived and/or modified sequence opt1 from TLR8__Homo_sapiens__AAI01076
auggagaacauguuccugcagagcuccaugcugaccugcaucuuccugcugaucagcggcuccugcgagcucugcgccgaggagaacuucagccgcuccuaccccugcgacgagaagaagcagaacgacagcgugaucgccgagugcuccaaccggcgccugcaggaggucccgcagaccguggggaaguacgugacggagcuggaccucagcgacaacuucaucacccacaucaccaacgaguccuuccagggccugcagaaccugaccaagaucaaccucaaccacaaccccaacguccagcaccagaacgggaaccccggcauccagagcaacgggcugaacaucacggacggcgcguuccugaaccucaagaaccugcgggagcugcuccuggaggacaaccagcugccccagaucccguccggccuccccgagagccugaccgagcugucccucauccagaacaacaucuacaacaucaccaaggaggggaucagccgccugaucaaccugaagaaccucuaccuggccuggaacugcuacuucaacaaggugugcgagaagaccaacaucgaggacggcguguucgagacgcugaccaaccucgagcugcugucccucagcuucaacucccugagccacgucccgcccaagcugcccuccagccuccggaagcuguuccugagcaacacccagaucaaguacaucuccgaggaggacuucaaggggcucaucaaccugacccugcucgaccugagcggcaacugcccccgcugcuucaacgcccccuuccccugcgugccgugcgacgggggcgccuccaucaacaucgaccgguucgccuuccagaaccugacgcagcuccgcuaccugaaccugagcuccaccagccuccggaagaucaacgcggccugguucaagaacaugccccaccugaaggugcuggaccucgaguucaacuaccuggucggcgagaucgccuccggggccuuccugaccaugcugccccgccucgagauccuggaccugagcuucaacuacaucaagggcuccuacccccagcacaucaacaucagccggaacuucuccaagcuccugagccugcgcgcgcuccaccuccggggguacguguuccaggagcugcgcgaggacgacuuccagccgcucaugcagcugcccaaccuguccaccaucaaccucggcaucaacuucaucaagcagaucgacuucaagcuguuccagaacuucagcaaccuggagaucaucuaccucuccgagaaccggaucagcccccuggugaaggacacgcgccaguccuacgccaacagcuccagcuuccagcggcacauccgcaagcggcgcagcaccgacuucgaguucgacccccacuccaacuucuaccacuucacccggccgcugaucaagccccagugcgccgccuacggcaaggcccucgaccugagccugaacuccaucuucuucaucgggcccaaccaguucgagaaccuccccgacaucgcgugccugaaccugagcgccaacuccaacgcccagguccucagcggcaccgaguucuccgccaucccgcacgugaaguaccuggaccugacgaacaaccgccucgacuucgacaacgccagcgcgcugaccgagcuguccgaccucgaggugcuggaccugagcuacaacucccacuacuuccgcaucgccggggucacccaccaccucgaguucauccagaacuucaccaaccugaaggugcugaaccucagccacaacaacaucuacacgcugaccgacaaguacaaccuggaguccaagagccucguggagcuggucuucuccggcaaccggcuggacauccucuggaacgacgacgacaaccgcuacaucagcaucuucaaggggcugaagaaccugacccggcucgaccugucccugaaccgccucaagcacauccccaacgaggccuuccugaaccugcccgccagccucaccgagcugcacaucaacgacaacaugcugaaguucuucaacuggacgcuccugcagcaguucccccggcuggagcuccuggaccugcgcggcaacaagcuccuguuccugaccgacagccucuccgacuucaccagcucccugcggacccugcuccugagccacaaccgcaucucccaccucccgagcggcuuccuguccgaggugagcucccugaagcaccuggaccucagcuccaaccugcugaagacgaucaacaagagcgcccucgagaccaagaccaccacgaagcuguccaugcuggagcuccacgggaaccccuucgagugcacgugcgacaucggcgacuuccggcgcuggauggacgagcaccugaacgugaagaucccccggcuggucgacgugaucugcgcgagcccgggggaccagcgcggcaaguccaucgugagccucgagcugacgaccugcgucuccgacgugaccgccgucauccuguucuucuucaccuucuucaucaccaccauggugaugcucgccgcccuggcccaccaccuguucuacugggacgugugguucaucuacaacgucugccucgcgaaggugaagggguaccggagccuguccaccagccagaccuucuacgacgccuacgugagcuacgacaccaaggacgccuccgucaccgacugggugaucaacgagcugcgcuaccaccucgaggagagccgggacaagaacgugcugcugugccucgaggagcgcgacugggaccccggccuggccaucaucgacaaccugaugcaguccaucaaccagagcaagaagaccgucuucgugcugacgaagaaguacgcgaaguccuggaacuucaagaccgccuucuaccucgcccugcagcggcugauggacgagaacauggacgugaucaucuucauccuccuggagcccguccugcagcacagccaguaccuccgccugcggcagcgcaucugcaaguccagcauccugcaguggcccgacaacccgaaggccgagggccucuucuggcagacccugcgcaacguggugcugaccgagaacgacucccgguacaacaacauguacgucgacagcaucaagcaguacuga

SEQ ID NO: 9784 - RNA, 3126 nt, Artificial Sequence
  derived and/or modified sequence opt2 from TLR8__Homo_sapiens__AAI01076
auggagaacauguuccuccaguccuccaugcucaccugcaucuuccuccucaucuccggcuccugcgagcucugcgccgaggagaacuucucccgcuccuaccccugcgacgagaagaagcagaacgacuccgucaucgccgagugcuccaaccgccgccuccaggaggucccccagaccgucggcaaguacgucaccgagcucgaccucuccgacaacuucaucacccacaucaccaacgaguccuuccagggccuccagaaccucaccaagaucaaccucaaccacaaccccaacguccagcaccagaacggcaaccccggcauccaguccaacggccucaacaucaccgacggcgccuuccucaaccucaagaaccuccgcgagcuccuccucgaggacaaccagcucccccagauccccuccggccuccccgagucccucaccgagcucucccucauccagaacaacaucuacaacaucaccaaggagggcaucucccgccucaucaaccucaagaaccucuaccucgccuggaacugcuacuucaacaaggucugcgagaagaccaacaucgaggacggcgucuucgagacccucaccaaccucgagcuccucucccucuccuucaacucccucucccacgucccccccaagcuccccuccucccuccgcaagcucuuccucuccaacacccagaucaaguacaucuccgaggaggacuucaagggccucaucaaccucacccuccucgaccucuccggcaacugcccccgcugcuucaacgcccccuuccccugcguccccugcgacggcggcgccuccaucaacaucgaccgcuucgccuuccagaaccucacccagcuccgcuaccucaaccucuccuccaccucccuccgcaagaucaacgccgccugguucaagaacaugccccaccucaagguccucgaccucgaguucaacuaccucgucggcgagaucgccuccggcgccuuccucaccaugcucccccgccucgagauccucgaccucuccuucaacuacaucaagggcuccuacccccagcacaucaacaucucccgcaacuucuccaagcuccucucccuccgcgcccuccaccuccgcggcuacgucuuccaggagcuccgcgaggacgacuuccagccccucaugcagcuccccaaccucuccaccaucaaccucggcaucaacuucaucaagcagaucgacuucaagcucuuccagaacuucuccaaccucgagaucaucuaccucuccgagaaccgcaucuccccccucgucaaggacacccgccaguccuacgccaacuccuccuccuuccagcgccacauccgcaagcgccgcuccaccgacuucgaguucgacccccacuccaacuucuaccacuucacccgcccccucaucaagccccagugcgccgccuacggcaaggcccucgaccucucccucaacuccaucuucuucaucggccccaaccaguucgagaaccuccccgacaucgccugccucaaccucuccgccaacuccaacgcccagguccucuccggcaccgaguucuccgccaucccccacgucaaguaccucgaccucaccaacaaccgccucgacuucgacaacgccuccgcccucaccgagcucuccgaccucgagguccucgaccucuccuacaacucccacuacuuccgcaucgccggcgucacccaccaccucgaguucauccagaacuucaccaaccucaagguccucaaccucucccacaacaacaucuacacccucaccgacaaguacaaccucgaguccaagucccucgucgagcucgucuucuccggcaaccgccucgacauccucuggaacgacgacgacaaccgcuacaucuccaucuucaagggccucaagaaccucacccgccucgaccucucccucaaccgccucaagcacauccccaacgaggccuuccucaaccuccccgccucccucaccgagcuccacaucaacgacaacaugcucaaguucuucaacuggacccuccuccagcaguucccccgccucgagcuccucgaccuccgcggcaacaagcuccucuuccucaccgacucccucuccgacuucaccuccucccuccgcacccuccuccucucccacaaccgcaucucccaccuccccuccggcuuccucuccgaggucuccucccucaagcaccucgaccucuccuccaaccuccucaagaccaucaacaaguccgcccucgagaccaagaccaccaccaagcucuccaugcucgagcuccacggcaaccccuucgagugcaccugcgacaucggcgacuuccgccgcuggauggacgagcaccucaacgucaagaucccccgccucgucgacgucaucugcgccucccccggcgaccagcgcggcaaguccaucgucucccucgagcucaccaccugcgucuccgacgucaccgccgucauccucuucuucuucaccuucuucaucaccaccauggucaugcucgccgcccucgcccaccaccucuucuacugggacgucugguucaucuacaacgucugccucgccaaggucaagggcuaccgcucccucuccaccucccagaccuucuacgacgccuacgucuccuacgacaccaaggacgccuccgucaccgacugggucaucaacgagcuccgcuaccaccucgaggagucccgcgacaagaacguccuccucugccucgaggagcgcgacugggaccccggccucgccaucaucgacaaccucaugcaguccaucaaccaguccaagaagaccgucuucguccucaccaagaaguacgccaaguccuggaacuucaagaccgccuucuaccucgcccuccagcgccucauggacgagaacauggacgucaucaucuucauccuccucgagcccguccuccagcacucccaguaccuccgccuccgccagcgcaucugcaaguccuccauccuccaguggcccgacaaccccaaggccgagggccucuucuggcagacccuccgcaacgucguccucaccgagaacgacucccgcuacaacaacauguacgucgacuccaucaagcaguacuga

SEQ ID NO: 9785 - RNA, 3126 nt, Artificial Sequence
  derived and/or modified sequence opt3 from TLR8__Homo_sapiens__AAI01076
auggagaacauguuccugcagagcuccauguugaccugcaucuuucuucugauuucuggcucaugugaauugugcgccgaggaaaauuucaguagaagcuaccccugugacgagaagaaacaaaacgauuccgugauagcugaaugcucuaauaggcgguuacaggaggucccucagacaguugggaaguaugugacugagcuggaccuaucggauaacuuuaucacgcacauuaccaaugaaucauuccagggacuccaaaaccugacaaaaaucaaucuuaaccauaauccaaacguacagcaccagaaugguaacccgggcauucagagcaaugggcugaacaucacugacggagcauuuuugaaucucaagaaccugcgcgagcugcucuuagaagauaaccaacugccccagauaccuaguggccuuccagaguccuugaccgagcugucucuaauccagaauaacauuuacaauaucacaaaagaagguauuagccgacucaucaaccugaagaaucuuuaucuggccuggaacuguuacuucaauaaggugugcgagaaaaccaacauagaagacggggucuuugagacuuugacaaaucucgaacuguuaucccugucauucaacagucucagccaugugcccccuaaacuuccaucuucccugcguaaguuguuucuaucaaauacccagauuaaguauaucagcgaggaggauuucaaaggacugauuaaccucacgcugcuugaccugaguggcaauugucccagaugcuuuaacgcgccuuucccauguguuccgugcgauggcggggcuucuaucaauaucgacagguuugccuuccaaaacuugacucagcuccgguaccugaacuuauccagcaccucgcugcgcaagauuaaugcagccugguucaagaacaugccccaccuaaaagugcucgaucuggaauuuaauuaucuugucggagagauagcuucuggugcauucuugacaaugcugccuagacucgaaauccuggaccuuuccuuuaacuacauuaagggcucauacccacagcauaucaauauaaguaggaacuucagcaaacuguugucccuccgggcccugcacuuacgcggguauguguuucaagagcugcgagaagaugacuuccagccccuaaugcagcucccuaaucugucuacuauuaaccuuggaaucaauuuuaucaagcagauugacuucaaauuguuucaaaacuucagcaaucuggagaucauuuaccucucagagaacagaauaaguccacugguaaaggauaccaggcaguccuaugcuaauucuucuucauuucagcggcacauccguaaacgcagaaguacagacuucgaauuugauccccauagcaacuucuaccacuucaccaggccguuaauuaagccucagugugccgcguauggcaaggcacuggaccuuuccuugaauagcaucuuuuucaucggucccaaccaauuugagaaccucccagauauugccugccugaaucuaucggcuaacagcaaugcccagguucuguccgggacggaauuuucagcaauaccucaugugaaauaccucgaccugacuaacaaucggcuugauuuugacaacgcuagugccuugacagagcugucugauuuagaaguccucgaccugagcuauaauucccacuacuuccgaaucgcgggagugacccaccaucuugaguuuauucagaacuucacuaaucugaagguguugaaccucucacacaauaacaucuacacacugaccgauaaauauaaucuagagagcaagucucuggucgaacucguuuucuccggcaaccgccuggacauucuuuggaaugacgaugacaacagauacaucaguauauucaaaggcuugaagaaccugacgagguuagaucucagccugaaucggcuuaagcauauccccaacgaggccuuucugaaucuaccagcaucucucaccgaacugcacauuaacgacaauauguugaaauucuuuaacuggacacuguuacagcaauucccccgccucgagcugcuugaucugagagggaauaagcuccucuuccugacugacucccuaucagauuuuaccaguagccugaggacacuucuccugucgcauaaccguaucucccacuugccuucuggauuccugagcgaggugucaaguuuaaaacaccucgaccuguccucuaaucuucugaagacuauuaacaaaagcgcuuuggaaaccaagacaaccacuaagcucuccaugcuggagcuacaugguaauccauuugaaugcacgugugauaucggcgacuuccggcgauggauggaugagcaccugaacguaaaaauaccgagacuuguggacgucauuugcgccucacccggggaucagaggggaaagagcaucgugagucucgaacugacaaccuguguuucugacgugacugcugucauuuuguuuuucuuuaccuucuuuaucacaaccauggugauguuagccgcacuggcccaucaccucuucuauugggacguaugguuuauauacaauguuugccuggcuaaagugaagggcuaucgcucccuuagcacuucgcagacauucuacgaugcguaugucucauacgacacgaaagaugcaucugugaccgacugggucaucaacgagcugcgguaccacuuggaggaaaguagagauaagaaugugcuacugugucucgaggaaagggacugggauccuggucuggccauuaucgacaaccuuaugcaguccauuaaucaaagcaagaaaacuguuuucguguuaacaaagaaauaugcuaagucuuggaacuuuaaaaccgccuucuaccuggcacuccagcgcuugauggaugagaacauggacguaaucauauuuauucugcucgaaccaguccugcagcauagccaauaucuucgacugcggcagcguaucugcaaguccucaaucuugcaguggcccgauaauccuaaagccgaggggcuauucuggcagacacugagaaacgugguucucacugagaaugacaguagguacaacaauauguauguggauagcauuaagcaauacuga

SEQ ID NO: 9786 - RNA, 3126 nt, Artificial Sequence
  derived and/or modified sequence opt4 from TLR8__Homo_sapiens__AAI01076
auggagaacauguuccugcagagcagcaugcugaccugcaucuuccugcugaucagcggcagcugcgagcugugcgccgaggagaacuucagcagaagcuaccccugcgacgagaagaagcagaacgacagcgugaucgccgagugcagcaacagaagacugcaggaggugccccagaccgugggcaaguacgugaccgagcuggaccugagcgacaacuucaucacccacaucaccaacgagagcuuccagggccugcagaaccugaccaagaucaaccugaaccacaaccccaacgugcagcaccagaacggcaaccccggcauccagagcaacggccugaacaucaccgacggcgccuuccugaaccugaagaaccugagagagcugcugcuggaggacaaccagcugccccagauccccagcggccugcccgagagccugaccgagcugagccugauccagaacaacaucuacaacaucaccaaggagggcaucagcagacugaucaaccugaagaaccuguaccuggccuggaacugcuacuucaacaaggugugcgagaagaccaacaucgaggacggcguguucgagacccugaccaaccuggagcugcugagccugagcuucaacagccugagccacgugccccccaagcugcccagcagccugagaaagcuguuccugagcaacacccagaucaaguacaucagcgaggaggacuucaagggccugaucaaccugacccugcuggaccugagcggcaacugccccagaugcuucaacgcccccuuccccugcgugcccugcgacggcggcgccagcaucaacaucgacagauucgccuuccagaaccugacccagcugagauaccugaaccugagcagcaccagccugagaaagaucaacgccgccugguucaagaacaugccccaccugaaggugcuggaccuggaguucaacuaccuggugggcgagaucgccagcggcgccuuccugaccaugcugcccagacuggagauccuggaccugagcuucaacuacaucaagggcagcuacccccagcacaucaacaucagcagaaacuucagcaagcugcugagccugagagcccugcaccugagaggcuacguguuccaggagcugagagaggacgacuuccagccccugaugcagcugcccaaccugagcaccaucaaccugggcaucaacuucaucaagcagaucgacuucaagcuguuccagaacuucagcaaccuggagaucaucuaccugagcgagaacagaaucagcccccuggugaaggacaccagacagagcuacgccaacagcagcagcuuccagagacacaucagaaagagaagaagcaccgacuucgaguucgacccccacagcaacuucuaccacuucaccagaccccugaucaagccccagugcgccgccuacggcaaggcccuggaccugagccugaacagcaucuucuucaucggccccaaccaguucgagaaccugcccgacaucgccugccugaaccugagcgccaacagcaacgcccaggugcugagcggcaccgaguucagcgccaucccccacgugaaguaccuggaccugaccaacaacagacuggacuucgacaacgccagcgcccugaccgagcugagcgaccuggaggugcuggaccugagcuacaacagccacuacuucagaaucgccggcgugacccaccaccuggaguucauccagaacuucaccaaccugaaggugcugaaccugagccacaacaacaucuacacccugaccgacaaguacaaccuggagagcaagagccugguggagcugguguucagcggcaacagacuggacauccuguggaacgacgacgacaacagauacaucagcaucuucaagggccugaagaaccugaccagacuggaccugagccugaacagacugaagcacauccccaacgaggccuuccugaaccugcccgccagccugaccgagcugcacaucaacgacaacaugcugaaguucuucaacuggacccugcugcagcaguuccccagacuggagcugcuggaccugagaggcaacaagcugcuguuccugaccgacagccugagcgacuucaccagcagccugagaacccugcugcugagccacaacagaaucagccaccugcccagcggcuuccugagcgaggugagcagccugaagcaccuggaccugagcagcaaccugcugaagaccaucaacaagagcgcccuggagaccaagaccaccaccaagcugagcaugcuggagcugcacggcaaccccuucgagugcaccugcgacaucggcgacuucagaagauggauggacgagcaccugaacgugaagauccccagacugguggacgugaucugcgccagccccggcgaccagagaggcaagagcaucgugagccuggagcugaccaccugcgugagcgacgugaccgccgugauccuguucuucuucaccuucuucaucaccaccauggugaugcuggccgcccuggcccaccaccuguucuacugggacgugugguucaucuacaacgugugccuggccaaggugaagggcuacagaagccugagcaccagccagaccuucuacgacgccuacgugagcuacgacaccaaggacgccagcgugaccgacugggugaucaacgagcugagauaccaccuggaggagagcagagacaagaacgugcugcugugccuggaggagagagacugggaccccggccuggccaucaucgacaaccugaugcagagcaucaaccagagcaagaagaccguguucgugcugaccaagaaguacgccaagagcuggaacuucaagaccgccuucuaccuggcccugcagagacugauggacgagaacauggacgugaucaucuucauccugcuggagcccgugcugcagcacagccaguaccugagacugagacagagaaucugcaagagcagcauccugcaguggcccgacaaccccaaggccgagggccuguucuggcagacccugagaaacguggugcugaccgagaacgacagcagauacaacaacauguacguggacagcaucaagcaguacuga

SEQ ID NO: 9787 - RNA, 3126 nt, Artificial Sequence
  derived and/or modified sequence opt5 from TLR8__Homo_sapiens__AAI01076
auggagaacauguuccugcagagcuccaugcugaccugcaucuuucugcuuauuucuggcagcugugaacugugcgccgaggaaaauuucuccagaucuuaccccugugacgagaagaaacaaaacgauagcgugaucgcugaaugcuccaaucggcgccuccaggaggucccucagacaguugggaaguaugugacggagcuggaccuuucugauaacuuuauuacccacaucacaaaugaauccuuccagggacugcaaaaccucaccaaaauuaaucugaaccauaauccgaacgugcagcaccagaauggcaaccccgggauccaguccaauggacugaacaucacagacggcgccuuucucaaucugaagaaccuuagagagcugcuccuggaagauaaccaacuuccucagauucccagcgggcugccugagucucucaccgagcugucccugauccagaauaacauuuacaauaucacaaaagaaggaauuagccggcucaucaaccugaagaaucuuuaucuggcguggaacuguuacuucaauaaggucugcgagaaaaccaacauugaagacggcguguuugagacgcucaccaaucuggaacuucugucucucuccuucaacagccugucucauguucccccuaagcugccguccagccuccgcaaacuguuucuuuccaauacacagaucaaguauaucucugaggaggauuucaaaggccugauuaaccucacccugcuugaccugagcgggaauugucccagaugcuuuaacgcuccuuuccccugugugccuugcgauggaggcgccuccaucaauauugaccgguuugccuuccaaaaccucacacagcugcgcuaccugaaccucagcucuaccucccugagaaagaucaaugcugccugguucaagaacaugccccaccuuaaaguccuggaucucgaauuuaauuaucuggugggggagauugcuagcggagccuuccugacgaugcuuccgcggcucgaaauccuggaccugucuuuuaacuacaucaagggcagcuacccucagcauauuaauaucucccgcaacuucucuaaacuccugagccuuagagcgcugcaccuccggggguauguuuuucaagagcugcgcgaagaugacuuccagccccugaugcagcuuccuaaucucuccacaauuaaccugggaaucaauuuuauuaagcagaucgacuucaaacuguuucaaaacuucagcaaucucgagaucauuuaccugucugagaacagaaucagcccccuugugaaggauacccggcagagcuaugccaauucuuccagcuuucagcgccacauuagaaaacggagauccacagacuucgaauuugauccccauucuaacuucuaccacuucacccgcccucugaucaagccgcagugugcugccuauggcaaggcucucgaccugagccucaauuccauuuucuucaucggccccaaccaauuugagaaccuuccugauauugccugccucaaucugucugcgaacagcaaugcccagguccuguccgggaccgaauuuagcgcuaucccccaugugaaauaccucgaccugacaaacaaucggcuugauuuugacaacgccucugcucugacggagcucuccgaucuggaagugcuggaccuuagcuauaauucucacuacuucagaaucgccggagucacccaccaucucgaguuuauucagaacuucacaaaucugaagguucugaaccucucccacaauaacaucuacacccugacagauaaauauaaucuugagagcaagucucugguggaacucguguuuagcggcaaccgccuggacauucuguggaaugacgaugacaaccgguacaucuccauuuucaaagggcuuaagaaccugaccagacucgaucugagccucaaucgccugaagcauaucccuaacgaggccuuucuuaaucugcccgcuucucucacggaacugcacaucaacgacaauaugcugaaauucuuuaacuggacacuucugcagcaauucccgcggcucgagcugcucgaucugagaggaaauaaacuucuguuccucaccgacucccugagcgauuuuaccuccucucugcgcacacuucugcucagccauaaccggauuucccaucugccuucuggcuuccucagcgaggucuccucucugaagcaccuugaccugagcuccaaucugcucaagaccaucaacaaaagcgcgcuggaaacaaagacgaccacaaaacuuucuaugcuggagcuccacgggaaucccuuugaaugcaccugugauauuggagacuucagacgcuggauggaugagcaccugaacgugaagaucccucggcucguugacgugauuugcgccucccccggcgaucagagaggcaagagcaucgucucucuggaacuuacaaccuguguguccgacguuacggcugugauccuguuuuucuuuaccuucuuuauuacaaccauggucaugcuggccgcccucgcucaucaccuguucuauugggacgugugguuuaucuacaaugucugccuugccaaagugaagggguaucggagccugucuacaucccagaccuucuacgaugcguauguuagcuacgacacgaaagaugcuuccgugacagacugggucauuaacgagcuccgcuaccaccuggaggaaagcagagauaagaaugugcuccugugucuugaggaacgggacugggauccuggacuggccaucauugacaaccugaugcagucuaucaaucaaagcaagaaaaccguuuucgugcucacaaagaaauaugccaaguccuggaacuuuaaaaccgcuuucuaccuggcccuucagagacugauggaugagaacauggacgucaucauuuuuauccuccuggaacccgugcuccagcauucucaauaucugcgccuucggcagagaauuugcaagagcuccauccugcaguggccggauaauccuaaagcugagggccuguucuggcagacccuccgcaacgugguucugacagagaaugacucuagauacaacaauauguaugucgauagcauuaagcaauacuga

SEQ ID NO: 9788 - protein, 1041 aa, Artificial Sequence [sequence omitted]

SEQ ID NO: 9789 - RNA, 3126 nt, Artificial Sequence
  TLR8__Homo_sapiens__AAI01075
auggaaaacauguuccuucagucgucaaugcugaccugcauuuuccugcuaauaucugguuccugugaguuaugcgccgaagaaaauuuuucuagaagcuauccuugugaugagaaaaagcaaaaugacucaguuauugcagagugcagcaaucgucgacuacaggaaguuccccaaacggugggcaaauaugugacagaacuagaccugucugauaauuucaucacacacauaacgaaugaaucauuucaagggcugcaaaaucucacuaaaauaaaucuaaaccacaaccccaauguacagcaccagaacggaaaucccgguauacaaucaaauggcuugaauaucacagacggggcauuccucaaccuaaaaaaccuaagggaguuacugcuugaagacaaccaguuaccccaaauacccucugguuugccagagucuuugacagaacuuagucuaauucaaaacaauauauacaacauaacuaaagagggcauuucaagacuuauaaacuugaaaaaucucuauuuggccuggaacugcuauuuuaacaaaguuugcgagaaaacuaacauagaagauggaguauuugaaacgcugacaaauuuggaguugcuaucacuaucuuucaauucucuuucacaugugccacccaaacugccaagcucccuacgcaaacuuuuucugagcaacacccagaucaaauacauuagugaagaagauuucaagggauugauaaauuuaacauuacuagauuuaagcgggaacuguccgaggugcuucaaugccccauuuccaugcgugccuugugaugguggugcuucaauuaauauagaucguuuugcuuuucaaaacuugacccaacuucgauaccuaaaccucucuagcacuucccucaggaagauuaaugcugccugguuuaaaaauaugccucaucugaaggugcuggaucuugaauucaacuauuuagugggagaaauagccucuggggcauuuuuaacgaugcugccccgcuuagaaauacuugacuugucuuuuaacuauauaaaggggaguuauccacagcauauuaauauuuccagaaacuucucuaaacuuuugucucuacgggcauugcauuuaagagguuauguguuccaggaacucagagaagaugauuuccagccccugaugcagcuuccaaacuuaucgacuaucaacuuggguauuaauuuuauuaagcaaaucgauuucaaacuuuuccaaaauuucuccaaucuggaaauuauuuacuugucagaaaacagaauaucaccguugguaaaagauacccggcagaguuaugcaaauaguuccucuuuucaacgucauauccggaaacgacgcucaacagauuuugaguuugacccacauucgaacuuuuaucauuucacccguccuuuaauaaagccacaaugugcugcuuauggaaaagccuuagauuuaagccucaacaguauuuucuucauugggccaaaccaauuugaaaaucuuccugacauugccuguuuaaaucugucugcaaauagcaaugcucaaguguuaaguggaacugaauuuucagccauuccucaugucaaauauuuggauuugacaaacaauagacuagacuuugauaaugcuagugcucuuacugaauuguccgacuuggaaguucuagaucucagcuauaauucacacuauuucagaauagcaggcguaacacaucaucuagaauuuauucaaaauuucacaaaucuaaaaguuuuaaacuugagccacaacaacauuuauacuuuaacagauaaguauaaccuggaaagcaagucccugguagaauuaguuuucaguggcaaucgccuugacauuuuguggaaugaugaugacaacagguauaucuccauuuucaaaggucucaagaaucugacacgucuggauuuaucccuuaauaggcucaagcacaucccaaaugaagcauuccuuaauuugccagcgagucucacugaacuacauauaaaugauaauauguuaaaguuuuuuaacuggacauuacuccagcaguuuccucgucucgaguugcuugacuuacguggaaacaaacuacucuuuuuaacugauagccuaucugacuuuacaucuucccuucggacacugcugcugagucauaacaggauuucccaccuacccucuggcuuucuuucugaagucaguagucugaagcaccucgauuuaaguuccaaucugcuaaaaacaauaaacaaauccgcacuugaaacuaagaccaccaccaaauuaucuauguuggaacuacacggaaaccccuuugaaugcaccugugacauuggagauuuccgaagauggauggaugaacaucugaaugucaaaauucccagacugguagaugucauuugugccaguccuggggaucaaagagggaagaguauugugagucuggagcuaacaacuuguguuucagaugucacugcagugauauuauuuuucuucacguucuuuaucaccaccaugguuauguuggcugcccuggcucaccauuuguuuuacugggauguuugguuuauauauaauguguguuuagcuaagguaaaaggcuacaggucucuuuccacaucccaaacuuucuaugaugcuuacauuucuuaugacaccaaagaugccucuguuacugacugggugauaaaugagcugugcuaccaccuugaagagagccgagacaaaaacguucuccuuugucuagaggagagggauugggacccgggauuggccaucaucgacaaccucaugcagagcaucaaccaaagcaagaaaacaguauuuguuuuaaccaaaaaauaugcaaaaagcuggaacuuuaaaacagcuuuuuacuuggcuuugcagaggcuaauggaugagaacauggaugugauuauauuuauccugcuggagccaguguuacagcauucucaguauuugaggcuacggcagcggaucuguaagagcuccauccuccaguggccugacaacccgaaggcagaaggcuuguuuuggcaaacucugagaaauguggucuugacugaaaaugauucacgguauaacaauauguaugucgauuccauuaagcaauacuaa

SEQ ID NO: 9790 - RNA, 3126 nt, Artificial Sequence
  derived and/or modified sequence opt1 from TLR8__Homo_sapiens__AAI01075
auggagaacauguuccugcagagcuccaugcugaccugcaucuuccugcugaucagcggcuccugcgagcucugcgccgaggagaacuucagccgcuccuaccccugcgacgagaagaagcagaacgacagcgugaucgccgagugcuccaaccggcgccugcaggaggucccgcagaccguggggaaguacgugacggagcuggaccucagcgacaacuucaucacccacaucaccaacgaguccuuccagggccugcagaaccugaccaagaucaaccucaaccacaaccccaacguccagcaccagaacgggaaccccggcauccagagcaacgggcugaacaucacggacggcgcguuccugaaccucaagaaccugcgggagcugcuccuggaggacaaccagcugccccagaucccguccggccuccccgagagccugaccgagcugucccucauccagaacaacaucuacaacaucaccaaggaggggaucagccgccugaucaaccugaagaaccucuaccuggccuggaacugcuacuucaacaaggugugcgagaagaccaacaucgaggacggcguguucgagacgcugaccaaccucgagcugcugucccucagcuucaacucccugagccacgucccgcccaagcugcccuccagccuccggaagcuguuccugagcaacacccagaucaaguacaucuccgaggaggacuucaaggggcucaucaaccugacccugcucgaccugagcggcaacugcccccgcugcuucaacgcccccuuccccugcgugccgugcgacgggggcgccuccaucaacaucgaccgguucgccuuccagaaccugacgcagcuccgcuaccugaaccugagcuccaccagccuccggaagaucaacgcggccugguucaagaacaugccccaccugaaggugcuggaccucgaguucaacuaccuggucggcgagaucgccuccggggccuuccugaccaugcugccccgccucgagauccuggaccugagcuucaacuacaucaagggcuccuacccccagcacaucaacaucagccggaacuucuccaagcuccugagccugcgcgcgcuccaccuccggggguacguguuccaggagcugcgcgaggacgacuuccagccgcucaugcagcugcccaaccuguccaccaucaaccucggcaucaacuucaucaagcagaucgacuucaagcuguuccagaacuucagcaaccuggagaucaucuaccucuccgagaaccggaucagcccccuggugaaggacacgcgccaguccuacgccaacagcuccagcuuccagcggcacauccgcaagcggcgcagcaccgacuucgaguucgacccccacuccaacuucuaccacuucacccggccgcugaucaagccccagugcgccgccuacggcaaggcccucgaccugagccugaacuccaucuucuucaucgggcccaaccaguucgagaaccuccccgacaucgcgugccugaaccugagcgccaacuccaacgcccagguccucagcggcaccgaguucuccgccaucccgcacgugaaguaccuggaccugacgaacaaccgccucgacuucgacaacgccagcgcgcugaccgagcuguccgaccucgaggugcuggaccugagcuacaacucccacuacuuccgcaucgccggggucacccaccaccucgaguucauccagaacuucaccaaccugaaggugcugaaccucagccacaacaacaucuacacgcugaccgacaaguacaaccuggaguccaagagccucguggagcuggucuucuccggcaaccggcuggacauccucuggaacgacgacgacaaccgcuacaucagcaucuucaaggggcugaagaaccugacccggcucgaccugucccugaaccgccucaagcacauccccaacgaggccuuccugaaccugcccgccagccucaccgagcugcacaucaacgacaacaugcugaaguucuucaacuggacgcuccugcagcaguucccccggcuggagcuccuggaccugcgcggcaacaagcuccuguuccugaccgacagccucuccgacuucaccagcucccugcggacccugcuccugagccacaaccgcaucucccaccucccgagcggcuuccuguccgaggugagcucccugaagcaccuggaccucagcuccaaccugcugaagacgaucaacaagagcgcccucgagaccaagaccaccacgaagcuguccaugcuggagcuccacgggaaccccuucgagugcacgugcgacaucggcgacuuccggcgcuggauggacgagcaccugaacgugaagaucccccggcuggucgacgugaucugcgcgagcccgggggaccagcgcggcaaguccaucgugagccucgagcugacgaccugcgucuccgacgugaccgccgucauccuguucuucuucaccuucuucaucaccaccauggugaugcucgccgcccuggcccaccaccuguucuacugggacgugugguucaucuacaacgucugccucgcgaaggugaagggguaccggagccuguccaccagccagaccuucuacgacgccuacaucagcuacgacaccaaggacgccuccgugaccgacugggucaucaacgagcugugcuaccaccucgaggagagccgcgacaagaacgugcugcugugccucgaggagcgggacugggaccccggccuggccaucaucgacaaccugaugcaguccaucaaccagagcaagaagaccguguucguccugacgaagaaguacgcgaaguccuggaacuucaagaccgccuucuaccucgcccugcagcgccugauggacgagaacauggacgugaucaucuucauccuccuggagcccgugcugcagcacagccaguaccuccggcugcgccagcggaucugcaaguccagcauccugcaguggcccgacaacccgaaggccgagggccucuucuggcagacccugcgcaacgucgugcugaccgagaacgacucccgcuacaacaacauguacguggacagcaucaagcaguacuga

SEQ ID NO: 9791 - RNA, 3126 nt, Artificial Sequence
  derived and/or modified sequence opt2 from TLR8__Homo_sapiens__AAI01075
auggagaacauguuccuccaguccuccaugcucaccugcaucuuccuccucaucuccggcuccugcgagcucugcgccgaggagaacuucucccgcuccuaccccugcgacgagaagaagcagaacgacuccgucaucgccgagugcuccaaccgccgccuccaggaggucccccagaccgucggcaaguacgucaccgagcucgaccucuccgacaacuucaucacccacaucaccaacgaguccuuccagggccuccagaaccucaccaagaucaaccucaaccacaaccccaacguccagcaccagaacggcaaccccggcauccaguccaacggccucaacaucaccgacggcgccuuccucaaccucaagaaccuccgcgagcuccuccucgaggacaaccagcucccccagauccccuccggccuccccgagucccucaccgagcucucccucauccagaacaacaucuacaacaucaccaaggagggcaucucccgccucaucaaccucaagaaccucuaccucgccuggaacugcuacuucaacaaggucugcgagaagaccaacaucgaggacggcgucuucgagacccucaccaaccucgagcuccucucccucuccuucaacucccucucccacgucccccccaagcuccccuccucccuccgcaagcucuuccucuccaacacccagaucaaguacaucuccgaggaggacuucaagggccucaucaaccucacccuccucgaccucuccggcaacugcccccgcugcuucaacgcccccuuccccugcguccccugcgacggcggcgccuccaucaacaucgaccgcuucgccuuccagaaccucacccagcuccgcuaccucaaccucuccuccaccucccuccgcaagaucaacgccgccugguucaagaacaugccccaccucaagguccucgaccucgaguucaacuaccucgucggcgagaucgccuccggcgccuuccucaccaugcucccccgccucgagauccucgaccucuccuucaacuacaucaagggcuccuacccccagcacaucaacaucucccgcaacuucuccaagcuccucucccuccgcgcccuccaccuccgcggcuacgucuuccaggagcuccgcgaggacgacuuccagccccucaugcagcuccccaaccucuccaccaucaaccucggcaucaacuucaucaagcagaucgacuucaagcucuuccagaacuucuccaaccucgagaucaucuaccucuccgagaaccgcaucuccccccucgucaaggacacccgccaguccuacgccaacuccuccuccuuccagcgccacauccgcaagcgccgcuccaccgacuucgaguucgacccccacuccaacuucuaccacuucacccgcccccucaucaagccccagugcgccgccuacggcaaggcccucgaccucucccucaacuccaucuucuucaucggccccaaccaguucgagaaccuccccgacaucgccugccucaaccucuccgccaacuccaacgcccagguccucuccggcaccgaguucuccgccaucccccacgucaaguaccucgaccucaccaacaaccgccucgacuucgacaacgccuccgcccucaccgagcucuccgaccucgagguccucgaccucuccuacaacucccacuacuuccgcaucgccggcgucacccaccaccucgaguucauccagaacuucaccaaccucaagguccucaaccucucccacaacaacaucuacacccucaccgacaaguacaaccucgaguccaagucccucgucgagcucgucuucuccggcaaccgccucgacauccucuggaacgacgacgacaaccgcuacaucuccaucuucaagggccucaagaaccucacccgccucgaccucucccucaaccgccucaagcacauccccaacgaggccuuccucaaccuccccgccucccucaccgagcuccacaucaacgacaacaugcucaaguucuucaacuggacccuccuccagcaguucccccgccucgagcuccucgaccuccgcggcaacaagcuccucuuccucaccgacucccucuccgacuucaccuccucccuccgcacccuccuccucucccacaaccgcaucucccaccuccccuccggcuuccucuccgaggucuccucccucaagcaccucgaccucuccuccaaccuccucaagaccaucaacaaguccgcccucgagaccaagaccaccaccaagcucuccaugcucgagcuccacggcaaccccuucgagugcaccugcgacaucggcgacuuccgccgcuggauggacgagcaccucaacgucaagaucccccgccucgucgacgucaucugcgccucccccggcgaccagcgcggcaaguccaucgucucccucgagcucaccaccugcgucuccgacgucaccgccgucauccucuucuucuucaccuucuucaucaccaccauggucaugcucgccgcccucgcccaccaccucuucuacugggacgucugguucaucuacaacgucugccucgccaaggucaagggcuaccgcucccucuccaccucccagaccuucuacgacgccuacaucuccuacgacaccaaggacgccuccgucaccgacugggucaucaacgagcucugcuaccaccucgaggagucccgcgacaagaacguccuccucugccucgaggagcgcgacugggaccccggccucgccaucaucgacaaccucaugcaguccaucaaccaguccaagaagaccgucuucguccucaccaagaaguacgccaaguccuggaacuucaagaccgccuucuaccucgcccuccagcgccucauggacgagaacauggacgucaucaucuucauccuccucgagcccguccuccagcacucccaguaccuccgccuccgccagcgcaucugcaaguccuccauccuccaguggcccgacaaccccaaggccgagggccucuucuggcagacccuccgcaacgucguccucaccgagaacgacucccgcuacaacaacauguacgucgacuccaucaagcaguacuga

SEQ ID NO: 9792 - RNA, 3126 nt, Artificial Sequence
  derived and/or modified sequence opt3 from TLR8__Homo_sapiens__AAI01075
auggagaacauguuccugcagagcuccauguugaccugcaucuuucuucugauuucuggcucaugugaauugugcgccgaggaaaauuucaguagaagcuaccccugugacgagaagaaacaaaacgauuccgugauagcugaaugcucuaauaggcgguuacaggaggucccucagacaguugggaaguaugugacugagcuggaccuaucggauaacuuuaucacgcacauuaccaaugaaucauuccagggacuccaaaaccugacaaaaaucaaucuuaaccauaauccaaacguacagcaccagaaugguaacccgggcauucagagcaaugggcugaacaucacugacggagcauuuuugaaucucaagaaccugcgcgagcugcucuuagaagauaaccaacugccccagauaccuaguggccuuccagaguccuugaccgagcugucucuaauccagaauaacauuuacaauaucacaaaagaagguauuagccgacucaucaaccugaagaaucuuuaucuggccuggaacuguuacuucaauaaggugugcgagaaaaccaacauagaagacggggucuuugagacuuugacaaaucucgaacuguuaucccugucauucaacagucucagccaugugcccccuaaacuuccaucuucccugcguaaguuguuucuaucaaauacccagauuaaguauaucagcgaggaggauuucaaaggacugauuaaccucacgcugcuugaccugaguggcaauugucccagaugcuuuaacgcgccuuucccauguguuccgugcgauggcggggcuucuaucaauaucgacagguuugccuuccaaaacuugacucagcuccgguaccugaacuuauccagcaccucgcugcgcaagauuaaugcagccugguucaagaacaugccccaccuaaaagugcucgaucuggaauuuaauuaucuugucggagagauagcuucuggugcauucuugacaaugcugccuagacucgaaauccuggaccuuuccuuuaacuacauuaagggcucauacccacagcauaucaauauaaguaggaacuucagcaaacuguugucccuccgggcccugcacuuacgcggguauguguuucaagagcugcgagaagaugacuuccagccccuaaugcagcucccuaaucugucuacuauuaaccuuggaaucaauuuuaucaagcagauugacuucaaauuguuucaaaacuucagcaaucuggagaucauuuaccucucagagaacagaauaaguccacugguaaaggauaccaggcaguccuaugcuaauucuucuucauuucagcggcacauccguaaacgcagaaguacagacuucgaauuugauccccauagcaacuucuaccacuucaccaggccguuaauuaagccucagugugccgcguauggcaaggcacuggaccuuuccuugaauagcaucuuuuucaucggucccaaccaauuugagaaccucccagauauugccugccugaaucuaucggcuaacagcaaugcccagguucuguccgggacggaauuuucagcaauaccucaugugaaauaccucgaccugacuaacaaucggcuugauuuugacaacgcuagugccuugacagagcugucugauuuagaaguccucgaccugagcuauaauucccacuacuuccgaaucgcgggagugacccaccaucuugaguuuauucagaacuucacuaaucugaagguguugaaccucucacacaauaacaucuacacacugaccgauaaauauaaucuagagagcaagucucuggucgaacucguuuucuccggcaaccgccuggacauucuuuggaaugacgaugacaacagauacaucaguauauucaaaggcuugaagaaccugacgagguuagaucucagccugaaucggcuuaagcauauccccaacgaggccuuucugaaucuaccagcaucucucaccgaacugcacauuaacgacaauauguugaaauucuuuaacuggacacuguuacagcaauucccccgccucgagcugcuugaucugagagggaauaagcuccucuuccugacugacucccuaucagauuuuaccaguagccugaggacacuucuccugucgcauaaccguaucucccacuugccuucuggauuccugagcgaggugucaaguuuaaaacaccucgaccuguccucuaaucuucugaagacuauuaacaaaagcgcuuuggaaaccaagacaaccacuaagcucuccaugcuggagcuacaugguaauccauuugaaugcacgugugauaucggcgacuuccggcgauggauggaugagcaccugaacguaaaaauaccgagacuuguggacgucauuugcgccucacccggggaucagaggggaaagagcaucgugagucucgaacugacaaccuguguuucugacgugacugcugucauuuuguuuuucuuuaccuucuuuaucacaaccauggugauguuagccgcacuggcccaucaccucuucuauugggacguaugguuuauauacaauguuugccuggcuaaagugaagggcuaucgcucccuuagcacuucgcagacauucuacgaugcguauaucucauacgacacgaaagaugcaucugucaccgacugggugauuaacgagcuguguuaccacuuggaggaaagucgggauaagaauguccuacugugccucgaggaaagagacugggauccuggucuggccaucauugacaaccuuaugcaguccaucaaucaaagcaagaaaacuguguucguuuuaacaaagaaauaugcuaagucuuggaacuuuaaaaccgccuucuaccuggcacuccagagguugauggaugagaacauggacgugauaauuuuuauccugcucgaaccaguacugcagcauagccaauaucuucgccugcgacagcggaucuguaaguccucaauuuugcaguggcccgauaauccuaaagccgaggggcuauucuggcagacacugcguaacgucgugcucacugagaaugacaguagauacaacaauauguauguugauagcaucaagcaauacuga

SEQ ID NO: 9793 - RNA, 3126 nt, Artificial Sequence
  derived and/or modified sequence opt4 from TLR8__Homo_sapiens__AAI01075
auggagaacauguuccugcagagcagcaugcugaccugcaucuuccugcugaucagcggcagcugcgagcugugcgccgaggagaacuucagcagaagcuaccccugcgacgagaagaagcagaacgacagcgugaucgccgagugcagcaacagaagacugcaggaggugccccagaccgugggcaaguacgugaccgagcuggaccugagcgacaacuucaucacccacaucaccaacgagagcuuccagggccugcagaaccugaccaagaucaaccugaaccacaaccccaacgugcagcaccagaacggcaaccccggcauccagagcaacggccugaacaucaccgacggcgccuuccugaaccugaagaaccugagagagcugcugcuggaggacaaccagcugccccagauccccagcggccugcccgagagccugaccgagcugagccugauccagaacaacaucuacaacaucaccaaggagggcaucagcagacugaucaaccugaagaaccuguaccuggccuggaacugcuacuucaacaaggugugcgagaagaccaacaucgaggacggcguguucgagacccugaccaaccuggagcugcugagccugagcuucaacagccugagccacgugccccccaagcugcccagcagccugagaaagcuguuccugagcaacacccagaucaaguacaucagcgaggaggacuucaagggccugaucaaccugacccugcuggaccugagcggcaacugccccagaugcuucaacgcccccuuccccugcgugcccugcgacggcggcgccagcaucaacaucgacagauucgccuuccagaaccugacccagcugagauaccugaaccugagcagcaccagccugagaaagaucaacgccgccugguucaagaacaugccccaccugaaggugcuggaccuggaguucaacuaccuggugggcgagaucgccagcggcgccuuccugaccaugcugcccagacuggagauccuggaccugagcuucaacuacaucaagggcagcuacccccagcacaucaacaucagcagaaacuucagcaagcugcugagccugagagcccugcaccugagaggcuacguguuccaggagcugagagaggacgacuuccagccccugaugcagcugcccaaccugagcaccaucaaccugggcaucaacuucaucaagcagaucgacuucaagcuguuccagaacuucagcaaccuggagaucaucuaccugagcgagaacagaaucagcccccuggugaaggacaccagacagagcuacgccaacagcagcagcuuccagagacacaucagaaagagaagaagcaccgacuucgaguucgacccccacagcaacuucuaccacuucaccagaccccugaucaagccccagugcgccgccuacggcaaggcccuggaccugagccugaacagcaucuucuucaucggccccaaccaguucgagaaccugcccgacaucgccugccugaaccugagcgccaacagcaacgcccaggugcugagcggcaccgaguucagcgccaucccccacgugaaguaccuggaccugaccaacaacagacuggacuucgacaacgccagcgcccugaccgagcugagcgaccuggaggugcuggaccugagcuacaacagccacuacuucagaaucgccggcgugacccaccaccuggaguucauccagaacuucaccaaccugaaggugcugaaccugagccacaacaacaucuacacccugaccgacaaguacaaccuggagagcaagagccugguggagcugguguucagcggcaacagacuggacauccuguggaacgacgacgacaacagauacaucagcaucuucaagggccugaagaaccugaccagacuggaccugagccugaacagacugaagcacauccccaacgaggccuuccugaaccugcccgccagccugaccgagcugcacaucaacgacaacaugcugaaguucuucaacuggacccugcugcagcaguuccccagacuggagcugcuggaccugagaggcaacaagcugcuguuccugaccgacagccugagcgacuucaccagcagccugagaacccugcugcugagccacaacagaaucagccaccugcccagcggcuuccugagcgaggugagcagccugaagcaccuggaccugagcagcaaccugcugaagaccaucaacaagagcgcccuggagaccaagaccaccaccaagcugagcaugcuggagcugcacggcaaccccuucgagugcaccugcgacaucggcgacuucagaagauggauggacgagcaccugaacgugaagauccccagacugguggacgugaucugcgccagccccggcgaccagagaggcaagagcaucgugagccuggagcugaccaccugcgugagcgacgugaccgccgugauccuguucuucuucaccuucuucaucaccaccauggugaugcuggccgcccuggcccaccaccuguucuacugggacgugugguucaucuacaacgugugccuggccaaggugaagggcuacagaagccugagcaccagccagaccuucuacgacgccuacaucagcuacgacaccaaggacgccagcgugaccgacugggugaucaacgagcugugcuaccaccuggaggagagcagagacaagaacgugcugcugugccuggaggagagagacugggaccccggccuggccaucaucgacaaccugaugcagagcaucaaccagagcaagaagaccguguucgugcugaccaagaaguacgccaagagcuggaacuucaagaccgccuucuaccuggcccugcagagacugauggacgagaacauggacgugaucaucuucauccugcuggagcccgugcugcagcacagccaguaccugagacugagacagagaaucugcaagagcagcauccugcaguggcccgacaaccccaaggccgagggccuguucuggcagacccugagaaacguggugcugaccgagaacgacagcagauacaacaacauguacguggacagcaucaagcaguacuga

SEQ ID NO: 9794 - RNA, 3126 nt, Artificial Sequence
  derived and/or modified sequence opt5 from TLR8__Homo_sapiens__AAI01075
auggagaacauguuccugcagagcuccaugcugaccugcaucuuucugcuuauuucuggcagcugugaacugugcgccgaggaaaauuucuccagaucuuaccccugugacgagaagaaacaaaacgauagcgugaucgcugaaugcuccaaucggcgccuccaggaggucccucagacaguugggaaguaugugacggagcuggaccuuucugauaacuuuauuacccacaucacaaaugaauccuuccagggacugcaaaaccucaccaaaauuaaucugaaccauaauccgaacgugcagcaccagaauggcaaccccgggauccaguccaauggacugaacaucacagacggcgccuuucucaaucugaagaaccuuagagagcugcuccuggaagauaaccaacuuccucagauucccagcgggcugccugagucucucaccgagcugucccugauccagaauaacauuuacaauaucacaaaagaaggaauuagccggcucaucaaccugaagaaucuuuaucuggcguggaacuguuacuucaauaaggucugcgagaaaaccaacauugaagacggcguguuugagacgcucaccaaucuggaacuucugucucucuccuucaacagccugucucauguucccccuaagcugccguccagccuccgcaaacuguuucuuuccaauacacagaucaaguauaucucugaggaggauuucaaaggccugauuaaccucacccugcuugaccugagcgggaauugucccagaugcuuuaacgcuccuuuccccugugugccuugcgauggaggcgccuccaucaauauugaccgguuugccuuccaaaaccucacacagcugcgcuaccugaaccucagcucuaccucccugagaaagaucaaugcugccugguucaagaacaugccccaccuuaaaguccuggaucucgaauuuaauuaucuggugggggagauugcuagcggagccuuccugacgaugcuuccgcggcucgaaauccuggaccugucuuuuaacuacaucaagggcagcuacccucagcauauuaauaucucccgcaacuucucuaaacuccugagccuuagagcgcugcaccuccggggguauguuuuucaagagcugcgcgaagaugacuuccagccccugaugcagcuuccuaaucucuccacaauuaaccugggaaucaauuuuauuaagcagaucgacuucaaacuguuucaaaacuucagcaaucucgagaucauuuaccugucugagaacagaaucagcccccuugugaaggauacccggcagagcuaugccaauucuuccagcuuucagcgccacauuagaaaacggagauccacagacuucgaauuugauccccauucuaacuucuaccacuucacccgcccucugaucaagccgcagugugcugccuauggcaaggcucucgaccugagccucaauuccauuuucuucaucggccccaaccaauuugagaaccuuccugauauugccugccucaaucugucugcgaacagcaaugcccagguccuguccgggaccgaauuuagcgcuaucccccaugugaaauaccucgaccugacaaacaaucggcuugauuuugacaacgccucugcucugacggagcucuccgaucuggaagugcuggaccuuagcuauaauucucacuacuucagaaucgccggagucacccaccaucucgaguuuauucagaacuucacaaaucugaagguucugaaccucucccacaauaacaucuacacccugacagauaaauauaaucuugagagcaagucucugguggaacucguguuuagcggcaaccgccuggacauucuguggaaugacgaugacaaccgguacaucuccauuuucaaagggcuuaagaaccugaccagacucgaucugagccucaaucgccugaagcauaucccuaacgaggccuuucuuaaucugcccgcuucucucacggaacugcacaucaacgacaauaugcugaaauucuuuaacuggacacuucugcagcaauucccgcggcucgagcugcucgaucugagaggaaauaaacuucuguuccucaccgacucccugagcgauuuuaccuccucucugcgcacacuucugcucagccauaaccggauuucccaucugccuucuggcuuccucagcgaggucuccucucugaagcaccuugaccugagcuccaaucugcucaagaccaucaacaaaagcgcgcuggaaacaaagacgaccacaaaacuuucuaugcuggagcuccacgggaaucccuuugaaugcaccugugauauuggagacuucagacgcuggauggaugagcaccugaacgugaagaucccucggcucguugacgugauuugcgccucccccggcgaucagagaggcaagagcaucgucucucuggaacuuacaaccuguguguccgacguuacggcugugauccuguuuuucuuuaccuucuuuauuacaaccauggucaugcuggccgcccucgcucaucaccuguucuauugggacgugugguuuaucuacaaugucugccuugccaaagugaagggguaucggagccugucuacaucccagaccuucuacgaugcguauauuagcuacgacacgaaagaugcuuccguuacagacugggugaucaacgagcucuguuaccaccuggaggaaagccgcgauaagaauguccuccugugccuugaggaaagagacugggauccuggacuggccauuaucgacaaccugaugcagucuaucaaucaaagcaagaaaaccguguucguucucacaaagaaauaugccaaguccuggaacuuuaaaaccgcuuucuaccuggcccuucagcggcugauggaugagaacauggacgugauuaucuuuauucuccuggaacccguccuccagcauucucaauaucugagacuucgccagcggaucuguaagagcuccauucugcaguggccggauaauccuaaagcugagggccuguucuggcagacccucagaaacguggugcugacagagaaugacucucgcuacaacaauauguauguugauagcaucaagcaauacuga

SEQ ID NO: 9795 - protein, 1041 aa, Artificial Sequence
  TLR8__Homo_sapiens__Q9NR97
MENMFLQSSMLTCIFLLISGSCELCAEENFSRSYPCDEKKQNDSVIAECSNRRLQEVPQTVGKYVTELDLSDNFITHITNESFQGLQNLTKINLNHNPNVQHQNGNPGIQSNGLNITDGAFLNLKNLRELLLEDNQLPQIPSGLPESLTELSLIQNNIYNITKEGISRLINLKNLYLAWNCYFNKVCEKTNIEDGVFETLTNLELLSLSFNSLSHVPPKLPSSLRKLFLSNTQIKYISEEDFKGLINLTLLDLSGNCPRCFNAPFPCVPCDGGASINIDRFAFQNLTQLRYLNLSSTSLRKINAAWFKNMPHLKVLDLEFNYLVGEIASGAFLTMLPRLEILDLSFNYIKGSYPQHINISRNFSKLLSLRALHLRGYVFQELREDDFQPLMQLPNLSTINLGINFIKQIDFKLFQNFSNLEIIYLSENRISPLVKDTRQSYANSSSFQRHIRKRRSTDFEFDPHSNFYHFTRPLIKPQCAAYGKALDLSLNSIFFIGPNQFENLPDIACLNLSANSNAQVLSGTEFSAIPHVKYLDLTNNRLDFDNASALTELSDLEVLDLSYNSHYFRIAGVTHHLEFIQNFTNLKVLNLSHNNIYTLTDKYNLESKSLVELVFSGNRLDILWNDDDNRYISIFKGLKNLTRLDLSLNRLKHIPNEAFLNLPASLTELHINDNMLKFFNWTLLQQFPRLELLDLRGNKLLFLTDSLSDFTSSLRTLLLSHNRISHLPSGFLSEVSSLKHLDLSSNLLKTINKSALETKTTTKLSMLELHGNPFECTCDIGDFRRWMDEHLNVKIPRLVDVICASPGDQRGKSIVSLELTTCVSDVTAVILFFFTFFITTMVMLAALAHHLFYWDVWFIYNVCLAKVKGYRSLSTSQTFYDAYISYDTKDASVTDWVINELRYHLEESRDKNVLLCLEERDWDPGLAIIDNLMQSINQSKKTVFVLTKKYAKSWNFKTAFYLALQRLMDENMDVIIFILLEPVLQHSQYLRLRQRICKSSILQWPDNPKAEGLFWQTLRNVVLTENDSRYNNMYVDSIKQY

SEQ ID NO: 9796 - RNA, 3126 nt, Artificial Sequence
  TLR8__Homo_sapiens__AAF78036
auggaaaacauguuccuucagucgucaaugcugaccugcauuuuccugcuaauaucugguuccugugaguuaugcgccgaagaaaauuuuucuagaagcuauccuugugaugagaaaaagcaaaaugacucaguuauugcagagugcagcaaucgucgacuacaggaaguuccccaaacggugggcaaauaugugacagaacuagaccugucugauaauuucaucacacacauaacgaaugaaucauuucaagggcugcaaaaucucacuaaaauaaaucuaaaccacaaccccaauguacagcaccagaacggaaaucccgguauacaaucaaauggcuugaauaucacagacggggcauuccucaaccuaaaaaaccuaagggaguuacugcuugaagacaaccaguuaccccaaauacccucugguuugccagagucuuugacagaacuuagucuaauucaaaacaauauauacaacauaacuaaagagggcauuucaagacuuauaaacuugaaaaaucucuauuuggccuggaacugcuauuuuaacaaaguuugcgagaaaacuaacauagaagauggaguauuugaaacgcugacaaauuuggaguugcuaucacuaucuuucaauucucuuucacacgugccacccaaacugccaagcucccuacgcaaacuuuuucugagcaacacccagaucaaauacauuagugaagaagauuucaagggauugauaaauuuaacauuacuagauuuaagcgggaacuguccgaggugcuucaaugccccauuuccaugcgugccuugugaugguggugcuucaauuaauauagaucguuuugcuuuucaaaacuugacccaacuucgauaccuaaaccucucuagcacuucccucaggaagauuaaugcugccugguuuaaaaauaugccucaucugaaggugcuggaucuugaauucaacuauuuagugggagaaauagccucuggggcauuuuuaacgaugcugccccgcuuagaaauacuugacuugucuuuuaacuauauaaaggggaguuauccacagcauauuaauauuuccagaaacuucucuaaacuuuugucucuacgggcauugcauuuaagagguuauguguuccaggaacucagagaagaugauuuccagccccugaugcagcuuccaaacuuaucgacuaucaacuuggguauuaauuuuauuaagcaaaucgauuucaaacuuuuccaaaauuucuccaaucuggaaauuauuuacuugucagaaaacagaauaucaccguugguaaaagauacccggcagaguuaugcaaauaguuccucuuuucaacgucauauccggaaacgacgcucaacagauuuugaguuugacccacauucgaacuuuuaucauuucacccguccuuuaauaaagccacaaugugcugcuuauggaaaagccuuagauuuaagccucaacaguauuuucuucauugggccaaaccaauuugaaaaucuuccugacauugccuguuuaaaucugucugcaaauagcaaugcucaaguguuaaguggaacugaauuuucagccauuccucaugucaaauauuuggauuugacaaacaauagacuagacuuugauaaugcuagugcucuuacugaauuguccgacuuggaaguucuagaucucagcuauaauucacacuauuucagaauagcaggcguaacacaucaucuagaauuuauucaaaauuucacaaaucuaaaaguuuuaaacuugagccacaacaacauuuauacuuuaacagauaaguauaaccuggaaagcaagucccugguagaauuaguuuucaguggcaaucgccuugacauuuuguggaaugaugaugacaacagguauaucuccauuuucaaaggucucaagaaucugacacgucuggauuuaucccuuaauaggcugaagcacaucccaaaugaagcauuccuuaauuugccagcgagucucacugaacuacauauaaaugauaauauguuaaaguuuuuuaacuggacauuacuccagcaguucccucgucucgaguugcuugacuuacguggaaacaaacuacucuuuuuaacugauagccuaucugacuuuacaucuucccuucggacacugcugcugagucauaacaggauuucccaccuacccucuggcuuucuuucugaagucaguagucugaagcaccucgauuuaaguuccaaucugcuaaaaacaaucaacaaauccgcacuugaaacuaagaccaccaccaaauuaucuauguuggaacuacacggaaaccccuuugaaugcaccugugacauuggagauuuccgaagauggauggaugaacaucugaaugucaaaauucccagacugguagaugucauuugugccaguccuggggaucaaagagggaagaguauugugagucuggagcugacaacuuguguuucagaugucacugcagugauauuauuuuucuucacguucuuuaucaccaccaugguuauguuggcugcccuggcucaccauuuguuuuacugggauguuugguuuauauauaauguguguuuagcuaagguaaaaggcuacaggucucuuuccacaucccaaacuuucuaugaugcuuacauuucuuaugacaccaaagaugccucuguuacugacugggugauaaaugagcugcgcuaccaccuugaagagagccgagacaaaaacguucuccuuugucuagaggagagggauugggacccgggauuggccaucaucgacaaccucaugcagagcaucaaccaaagcaagaaaacaguauuuguuuuaaccaaaaaauaugcaaaaagcuggaacuuuaaaacagcuuuuuacuuggcuuugcagaggcuaauggaugagaacauggaugugauuauauuuauccugcuggagccaguguuacagcauucucaguauuugaggcuacggcagcggaucuguaagagcuccauccuccaguggccugacaacccgaaggcagaaggcuuguuuuggcaaacucugagaaauguggucuugacugaaaaugauucacgguauaacaauauguaugucgauuccauuaagcaauacuaa

SEQ ID NO: 9797 - RNA, 3126 nt, Artificial Sequence
  derived and/or modified sequence opt1 from TLR8__Homo_sapiens__AAF78036
auggagaacauguuccugcagagcuccaugcugaccugcaucuuccugcugaucagcggcuccugcgagcucugcgccgaggagaacuucagccgcuccuaccccugcgacgagaagaagcagaacgacagcgugaucgccgagugcuccaaccggcgccugcaggaggucccgcagaccguggggaaguacgugacggagcuggaccucagcgacaacuucaucacccacaucaccaacgaguccuuccagggccugcagaaccugaccaagaucaaccucaaccacaaccccaacguccagcaccagaacgggaaccccggcauccagagcaacgggcugaacaucacggacggcgcguuccugaaccucaagaaccugcgggagcugcuccuggaggacaaccagcugccccagaucccguccggccuccccgagagccugaccgagcugucccucauccagaacaacaucuacaacaucaccaaggaggggaucagccgccugaucaaccugaagaaccucuaccuggccuggaacugcuacuucaacaaggugugcgagaagaccaacaucgaggacggcguguucgagacgcugaccaaccucgagcugcugucccucagcuucaacucccugagccacgucccgcccaagcugcccuccagccuccggaagcuguuccugagcaacacccagaucaaguacaucuccgaggaggacuucaaggggcucaucaaccugacccugcucgaccugagcggcaacugcccccgcugcuucaacgcccccuuccccugcgugccgugcgacgggggcgccuccaucaacaucgaccgguucgccuuccagaaccugacgcagcuccgcuaccugaaccugagcuccaccagccuccggaagaucaacgcggccugguucaagaacaugccccaccugaaggugcuggaccucgaguucaacuaccuggucggcgagaucgccuccggggccuuccugaccaugcugccccgccucgagauccuggaccugagcuucaacuacaucaagggcuccuacccccagcacaucaacaucagccggaacuucuccaagcuccugagccugcgcgcgcuccaccuccggggguacguguuccaggagcugcgcgaggacgacuuccagccgcucaugcagcugcccaaccuguccaccaucaaccucggcaucaacuucaucaagcagaucgacuucaagcuguuccagaacuucagcaaccuggagaucaucuaccucuccgagaaccggaucagcccccuggugaaggacacgcgccaguccuacgccaacagcuccagcuuccagcggcacauccgcaagcggcgcagcaccgacuucgaguucgacccccacuccaacuucuaccacuucacccggccgcugaucaagccccagugcgccgccuacggcaaggcccucgaccugagccugaacuccaucuucuucaucgggcccaaccaguucgagaaccuccccgacaucgcgugccugaaccugagcgccaacuccaacgcccagguccucagcggcaccgaguucuccgccaucccgcacgugaaguaccuggaccugacgaacaaccgccucgacuucgacaacgccagcgcgcugaccgagcuguccgaccucgaggugcuggaccugagcuacaacucccacuacuuccgcaucgccggggucacccaccaccucgaguucauccagaacuucaccaaccugaaggugcugaaccucagccacaacaacaucuacacgcugaccgacaaguacaaccuggaguccaagagccucguggagcuggucuucuccggcaaccggcuggacauccucuggaacgacgacgacaaccgcuacaucagcaucuucaaggggcugaagaaccugacccggcucgaccugucccugaaccgccucaagcacauccccaacgaggccuuccugaaccugcccgccagccucaccgagcugcacaucaacgacaacaugcugaaguucuucaacuggacgcuccugcagcaguucccccggcuggagcuccuggaccugcgcggcaacaagcuccuguuccugaccgacagccucuccgacuucaccagcucccugcggacccugcuccugagccacaaccgcaucucccaccucccgagcggcuuccuguccgaggugagcucccugaagcaccuggaccucagcuccaaccugcugaagacgaucaacaagagcgcccucgagaccaagaccaccacgaagcuguccaugcuggagcuccacgggaaccccuucgagugcacgugcgacaucggcgacuuccggcgcuggauggacgagcaccugaacgugaagaucccccggcuggucgacgugaucugcgcgagcccgggggaccagcgcggcaaguccaucgugagccucgagcugacgaccugcgucuccgacgugaccgccgucauccuguucuucuucaccuucuucaucaccaccauggugaugcucgccgcccuggcccaccaccuguucuacugggacgugugguucaucuacaacgucugccucgcgaaggugaagggguaccggagccuguccaccagccagaccuucuacgacgccuacaucagcuacgacaccaaggacgccuccgugaccgacugggucaucaacgagcugcgcuaccaccucgaggagagccgggacaagaacgugcugcugugccucgaggagcgcgacugggaccccggccuggccaucaucgacaaccugaugcaguccaucaaccagagcaagaagaccguguucguccugacgaagaaguacgcgaaguccuggaacuucaagaccgccuucuaccucgcccugcagcggcugauggacgagaacauggacgugaucaucuucauccuccuggagcccgugcugcagcacagccaguaccuccgccugcggcagcgcaucugcaaguccagcauccugcaguggcccgacaacccgaaggccgagggccucuucuggcagacccugcgcaacgucgugcugaccgagaacgacucccgguacaacaacauguacguggacagcaucaagcaguacuga

SEQ ID NO: 9798 - RNA, 3126 nt, Artificial Sequence
  derived and/or modified sequence opt2 from TLR8__Homo_sapiens__AAF78036
auggagaacauguuccuccaguccuccaugcucaccugcaucuuccuccucaucuccggcuccugcgagcucugcgccgaggagaacuucucccgcuccuaccccugcgacgagaagaagcagaacgacuccgucaucgccgagugcuccaaccgccgccuccaggaggucccccagaccgucggcaaguacgucaccgagcucgaccucuccgacaacuucaucacccacaucaccaacgaguccuuccagggccuccagaaccucaccaagaucaaccucaaccacaaccccaacguccagcaccagaacggcaaccccggcauccaguccaacggccucaacaucaccgacggcgccuuccucaaccucaagaaccuccgcgagcuccuccucgaggacaaccagcucccccagauccccuccggccuccccgagucccucaccgagcucucccucauccagaacaacaucuacaacaucaccaaggagggcaucucccgccucaucaaccucaagaaccucuaccucgccuggaacugcuacuucaacaaggucugcgagaagaccaacaucgaggacggcgucuucgagacccucaccaaccucgagcuccucucccucuccuucaacucccucucccacgucccccccaagcuccccuccucccuccgcaagcucuuccucuccaacacccagaucaaguacaucuccgaggaggacuucaagggccucaucaaccucacccuccucgaccucuccggcaacugcccccgcugcuucaacgcccccuuccccugcguccccugcgacggcggcgccuccaucaacaucgaccgcuucgccuuccagaaccucacccagcuccgcuaccucaaccucuccuccaccucccuccgcaagaucaacgccgccugguucaagaacaugccccaccucaagguccucgaccucgaguucaacuaccucgucggcgagaucgccuccggcgccuuccucaccaugcucccccgccucgagauccucgaccucuccuucaacuacaucaagggcuccuacccccagcacaucaacaucucccgcaacuucuccaagcuccucucccuccgcgcccuccaccuccgcggcuacgucuuccaggagcuccgcgaggacgacuuccagccccucaugcagcuccccaaccucuccaccaucaaccucggcaucaacuucaucaagcagaucgacuucaagcucuuccagaacuucuccaaccucgagaucaucuaccucuccgagaaccgcaucuccccccucgucaaggacacccgccaguccuacgccaacuccuccuccuuccagcgccacauccgcaagcgccgcuccaccgacuucgaguucgacccccacuccaacuucuaccacuucacccgcccccucaucaagccccagugcgccgccuacggcaaggcccucgaccucucccucaacuccaucuucuucaucggccccaaccaguucgagaaccuccccgacaucgccugccucaaccucuccgccaacuccaacgcccagguccucuccggcaccgaguucuccgccaucccccacgucaaguaccucgaccucaccaacaaccgccucgacuucgacaacgccuccgcccucaccgagcucuccgaccucgagguccucgaccucuccuacaacucccacuacuuccgcaucgccggcgucacccaccaccucgaguucauccagaacuucaccaaccucaagguccucaaccucucccacaacaacaucuacacccucaccgacaaguacaaccucgaguccaagucccucgucgagcucgucuucuccggcaaccgccucgacauccucuggaacgacgacgacaaccgcuacaucuccaucuucaagggccucaagaaccucacccgccucgaccucucccucaaccgccucaagcacauccccaacgaggccuuccucaaccuccccgccucccucaccgagcuccacaucaacgacaacaugcucaaguucuucaacuggacccuccuccagcaguucccccgccucgagcuccucgaccuccgcggcaacaagcuccucuuccucaccgacucccucuccgacuucaccuccucccuccgcacccuccuccucucccacaaccgcaucucccaccuccccuccggcuuccucuccgaggucuccucccucaagcaccucgaccucuccuccaaccuccucaagaccaucaacaaguccgcccucgagaccaagaccaccaccaagcucuccaugcucgagcuccacggcaaccccuucgagugcaccugcgacaucggcgacuuccgccgcuggauggacgagcaccucaacgucaagaucccccgccucgucgacgucaucugcgccucccccggcgaccagcgcggcaaguccaucgucucccucgagcucaccaccugcgucuccgacgucaccgccgucauccucuucuucuucaccuucuucaucaccaccauggucaugcucgccgcccucgcccaccaccucuucuacugggacgucugguucaucuacaacgucugccucgccaaggucaagggcuaccgcucccucuccaccucccagaccuucuacgacgccuacaucuccuacgacaccaaggacgccuccgucaccgacugggucaucaacgagcuccgcuaccaccucgaggagucccgcgacaagaacguccuccucugccucgaggagcgcgacugggaccccggccucgccaucaucgacaaccucaugcaguccaucaaccaguccaagaagaccgucuucguccucaccaagaaguacgccaaguccuggaacuucaagaccgccuucuaccucgcccuccagcgccucauggacgagaacauggacgucaucaucuucauccuccucgagcccguccuccagcacucccaguaccuccgccuccgccagcgcaucugcaaguccuccauccuccaguggcccgacaaccccaaggccgagggccucuucuggcagacccuccgcaacgucguccucaccgagaacgacucccgcuacaacaacauguacgucgacuccaucaagcaguacuga

SEQ ID NO: 9799 - RNA, 3126 nt, Artificial Sequence
  derived and/or modified sequence opt3 from TLR8__Homo_sapiens__AAF78036
auggagaacauguuccugcagagcuccauguugaccugcaucuuucuucugauuucuggcucaugugaauugugcgccgaggaaaauuucaguagaagcuaccccugugacgagaagaaacaaaacgauuccgugauagcugaaugcucuaauaggcgguuacaggaggucccucagacaguugggaaguaugugacugagcuggaccuaucggauaacuuuaucacgcacauuaccaaugaaucauuccagggacuccaaaaccugacaaaaaucaaucuuaaccauaauccaaacguacagcaccagaaugguaacccgggcauucagagcaaugggcugaacaucacugacggagcauuuuugaaucucaagaaccugcgcgagcugcucuuagaagauaaccaacugccccagauaccuaguggccuuccagaguccuugaccgagcugucucuaauccagaauaacauuuacaauaucacaaaagaagguauuagccgacucaucaaccugaagaaucuuuaucuggccuggaacuguuacuucaauaaggugugcgagaaaaccaacauagaagacggggucuuugagacuuugacaaaucucgaacuguuaucccugucauucaacagucucagccaugugcccccuaaacuuccaucuucccugcguaaguuguuucuaucaaauacccagauuaaguauaucagcgaggaggauuucaaaggacugauuaaccucacgcugcuugaccugaguggcaauugucccagaugcuuuaacgcgccuuucccauguguuccgugcgauggcggggcuucuaucaauaucgacagguuugccuuccaaaacuugacucagcuccgguaccugaacuuauccagcaccucgcugcgcaagauuaaugcagccugguucaagaacaugccccaccuaaaagugcucgaucuggaauuuaauuaucuugucggagagauagcuucuggugcauucuugacaaugcugccuagacucgaaauccuggaccuuuccuuuaacuacauuaagggcucauacccacagcauaucaauauaaguaggaacuucagcaaacuguugucccuccgggcccugcacuuacgcggguauguguuucaagagcugcgagaagaugacuuccagccccuaaugcagcucccuaaucugucuacuauuaaccuuggaaucaauuuuaucaagcagauugacuucaaauuguuucaaaacuucagcaaucuggagaucauuuaccucucagagaacagaauaaguccacugguaaaggauaccaggcaguccuaugcuaauucuucuucauuucagcggcacauccguaaacgcagaaguacagacuucgaauuugauccccauagcaacuucuaccacuucaccaggccguuaauuaagccucagugugccgcguauggcaaggcacuggaccuuuccuugaauagcaucuuuuucaucggucccaaccaauuugagaaccucccagauauugccugccugaaucuaucggcuaacagcaaugcccagguucuguccgggacggaauuuucagcaauaccucaugugaaauaccucgaccugacuaacaaucggcuugauuuugacaacgcuagugccuugacagagcugucugauuuagaaguccucgaccugagcuauaauucccacuacuuccgaaucgcgggagugacccaccaucuugaguuuauucagaacuucacuaaucugaagguguugaaccucucacacaauaacaucuacacacugaccgauaaauauaaucuagagagcaagucucuggucgaacucguuuucuccggcaaccgccuggacauucuuuggaaugacgaugacaacagauacaucaguauauucaaaggcuugaagaaccugacgagguuagaucucagccugaaucggcuuaagcauauccccaacgaggccuuucugaaucuaccagcaucucucaccgaacugcacauuaacgacaauauguugaaauucuuuaacuggacacuguuacagcaauucccccgccucgagcugcuugaucugagagggaauaagcuccucuuccugacugacucccuaucagauuuuaccaguagccugaggacacuucuccugucgcauaaccguaucucccacuugccuucuggauuccugagcgaggugucaaguuuaaaacaccucgaccuguccucuaaucuucugaagacuauuaacaaaagcgcuuuggaaaccaagacaaccacuaagcucuccaugcuggagcuacaugguaauccauuugaaugcacgugugauaucggcgacuuccggcgauggauggaugagcaccugaacguaaaaauaccgagacuuguggacgucauuugcgccucacccggggaucagaggggaaagagcaucgugagucucgaacugacaaccuguguuucugacgugacugcugucauuuuguuuuucuuuaccuucuuuaucacaaccauggugauguuagccgcacuggcccaucaccucuucuauugggacguaugguuuauauacaauguuugccuggcuaaagugaagggcuaucgcucccuuagcacuucgcagacauucuacgaugcguauaucucauacgacacgaaagaugcaucugucaccgacugggugauuaacgagcugcgguaccacuuggaggaaaguagagauaagaauguccuacugugucucgaggaaagggacugggauccuggucuggccaucauugacaaccuuaugcaguccaucaaucaaagcaagaaaacuguguucguuuuaacaaagaaauaugcuaagucuuggaacuuuaaaaccgccuucuaccuggcacuccagcgcuugauggaugagaacauggacgugauaauuuuuauccugcucgaaccaguacugcagcauagccaauaucuucgacugcggcagcguaucugcaaguccucaauuuugcaguggcccgauaauccuaaagccgaggggcuauucuggcagacacugagaaacgucgugcucacugagaaugacaguagguacaacaauauguauguugauagcaucaagcaauacuga

SEQ ID NO: 9800 - RNA, 3126 nt, Artificial Sequence
  derived and/or modified sequence opt4 from TLR8__Homo_sapiens__AAF78036
auggagaacauguuccugcagagcagcaugcugaccugcaucuuccugcugaucagcggcagcugcgagcugugcgccgaggagaacuucagcagaagcuaccccugcgacgagaagaagcagaacgacagcgugaucgccgagugcagcaacagaagacugcaggaggugccccagaccgugggcaaguacgugaccgagcuggaccugagcgacaacuucaucacccacaucaccaacgagagcuuccagggccugcagaaccugaccaagaucaaccugaaccacaaccccaacgugcagcaccagaacggcaaccccggcauccagagcaacggccugaacaucaccgacggcgccuuccugaaccugaagaaccugagagagcugcugcuggaggacaaccagcugccccagauccccagcggccugcccgagagccugaccgagcugagccugauccagaacaacaucuacaacaucaccaaggagggcaucagcagacugaucaaccugaagaaccuguaccuggccuggaacugcuacuucaacaaggugugcgagaagaccaacaucgaggacggcguguucgagacccugaccaaccuggagcugcugagccugagcuucaacagccugagccacgugccccccaagcugcccagcagccugagaaagcuguuccugagcaacacccagaucaaguacaucagcgaggaggacuucaagggccugaucaaccugacccugcuggaccugagcggcaacugccccagaugcuucaacgcccccuuccccugcgugcccugcgacggcggcgccagcaucaacaucgacagauucgccuuccagaaccugacccagcugagauaccugaaccugagcagcaccagccugagaaagaucaacgccgccugguucaagaacaugccccaccugaaggugcuggaccuggaguucaacuaccuggugggcgagaucgccagcggcgccuuccugaccaugcugcccagacuggagauccuggaccugagcuucaacuacaucaagggcagcuacccccagcacaucaacaucagcagaaacuucagcaagcugcugagccugagagcccugcaccugagaggcuacguguuccaggagcugagagaggacgacuuccagccccugaugcagcugcccaaccugagcaccaucaaccugggcaucaacuucaucaagcagaucgacuucaagcuguuccagaacuucagcaaccuggagaucaucuaccugagcgagaacagaaucagcccccuggugaaggacaccagacagagcuacgccaacagcagcagcuuccagagacacaucagaaagagaagaagcaccgacuucgaguucgacccccacagcaacuucuaccacuucaccagaccccugaucaagccccagugcgccgccuacggcaaggcccuggaccugagccugaacagcaucuucuucaucggccccaaccaguucgagaaccugcccgacaucgccugccugaaccugagcgccaacagcaacgcccaggugcugagcggcaccgaguucagcgccaucccccacgugaaguaccuggaccugaccaacaacagacuggacuucgacaacgccagcgcccugaccgagcugagcgaccuggaggugcuggaccugagcuacaacagccacuacuucagaaucgccggcgugacccaccaccuggaguucauccagaacuucaccaaccugaaggugcugaaccugagccacaacaacaucuacacccugaccgacaaguacaaccuggagagcaagagccugguggagcugguguucagcggcaacagacuggacauccuguggaacgacgacgacaacagauacaucagcaucuucaagggccugaagaaccugaccagacuggaccugagccugaacagacugaagcacauccccaacgaggccuuccugaaccugcccgccagccugaccgagcugcacaucaacgacaacaugcugaaguucuucaacuggacccugcugcagcaguuccccagacuggagcugcuggaccugagaggcaacaagcugcuguuccugaccgacagccugagcgacuucaccagcagccugagaacccugcugcugagccacaacagaaucagccaccugcccagcggcuuccugagcgaggugagcagccugaagcaccuggaccugagcagcaaccugcugaagaccaucaacaagagcgcccuggagaccaagaccaccaccaagcugagcaugcuggagcugcacggcaaccccuucgagugcaccugcgacaucggcgacuucagaagauggauggacgagcaccugaacgugaagauccccagacugguggacgugaucugcgccagccccggcgaccagagaggcaagagcaucgugagccuggagcugaccaccugcgugagcgacgugaccgccgugauccuguucuucuucaccuucuucaucaccaccauggugaugcuggccgcccuggcccaccaccuguucuacugggacgugugguucaucuacaacgugugccuggccaaggugaagggcuacagaagccugagcaccagccagaccuucuacgacgccuacaucagcuacgacaccaaggacgccagcgugaccgacugggugaucaacgagcugagauaccaccuggaggagagcagagacaagaacgugcugcugugccuggaggagagagacugggaccccggccuggccaucaucgacaaccugaugcagagcaucaaccagagcaagaagaccguguucgugcugaccaagaaguacgccaagagcuggaacuucaagaccgccuucuaccuggcccugcagagacugauggacgagaacauggacgugaucaucuucauccugcuggagcccgugcugcagcacagccaguaccugagacugagacagagaaucugcaagagcagcauccugcaguggcccgacaaccccaaggccgagggccuguucuggcagacccugagaaacguggugcugaccgagaacgacagcagauacaacaacauguacguggacagcaucaagcaguacuga

SEQ ID NO: 9801 - RNA, 3126 nt, Artificial Sequence
  derived and/or modified sequence opt5 from TLR8__Homo_sapiens__AAF78036
auggagaacauguuccugcagagcuccaugcugaccugcaucuuucugcuuauuucuggcagcugugaacugugcgccgaggaaaauuucuccagaucuuaccccugugacgagaagaaacaaaacgauagcgugaucgcugaaugcuccaaucggcgccuccaggaggucccucagacaguugggaaguaugugacggagcuggaccuuucugauaacuuuauuacccacaucacaaaugaauccuuccagggacugcaaaaccucaccaaaauuaaucugaaccauaauccgaacgugcagcaccagaauggcaaccccgggauccaguccaauggacugaacaucacagacggcgccuuucucaaucugaagaaccuuagagagcugcuccuggaagauaaccaacuuccucagauucccagcgggcugccugagucucucaccgagcugucccugauccagaauaacauuuacaauaucacaaaagaaggaauuagccggcucaucaaccugaagaaucuuuaucuggcguggaacuguuacuucaauaaggucugcgagaaaaccaacauugaagacggcguguuugagacgcucaccaaucuggaacuucugucucucuccuucaacagccugucucauguucccccuaagcugccguccagccuccgcaaacuguuucuuuccaauacacagaucaaguauaucucugaggaggauuucaaaggccugauuaaccucacccugcuugaccugagcgggaauugucccagaugcuuuaacgcuccuuuccccugugugccuugcgauggaggcgccuccaucaauauugaccgguuugccuuccaaaaccucacacagcugcgcuaccugaaccucagcucuaccucccugagaaagaucaaugcugccugguucaagaacaugccccaccuuaaaguccuggaucucgaauuuaauuaucuggugggggagauugcuagcggagccuuccugacgaugcuuccgcggcucgaaauccuggaccugucuuuuaacuacaucaagggcagcuacccucagcauauuaauaucucccgcaacuucucuaaacuccugagccuuagagcgcugcaccuccggggguauguuuuucaagagcugcgcgaagaugacuuccagccccugaugcagcuuccuaaucucuccacaauuaaccugggaaucaauuuuauuaagcagaucgacuucaaacuguuucaaaacuucagcaaucucgagaucauuuaccugucugagaacagaaucagcccccuugugaaggauacccggcagagcuaugccaauucuuccagcuuucagcgccacauuagaaaacggagauccacagacuucgaauuugauccccauucuaacuucuaccacuucacccgcccucugaucaagccgcagugugcugccuauggcaaggcucucgaccugagccucaauuccauuuucuucaucggccccaaccaauuugagaaccuuccugauauugccugccucaaucugucugcgaacagcaaugcccagguccuguccgggaccgaauuuagcgcuaucccccaugugaaauaccucgaccugacaaacaaucggcuugauuuugacaacgccucugcucugacggagcucuccgaucuggaagugcuggaccuuagcuauaauucucacuacuucagaaucgccggagucacccaccaucucgaguuuauucagaacuucacaaaucugaagguucugaaccucucccacaauaacaucuacacccugacagauaaauauaaucuugagagcaagucucugguggaacucguguuuagcggcaaccgccuggacauucuguggaaugacgaugacaaccgguacaucuccauuuucaaagggcuuaagaaccugaccagacucgaucugagccucaaucgccugaagcauaucccuaacgaggccuuucuuaaucugcccgcuucucucacggaacugcacaucaacgacaauaugcugaaauucuuuaacuggacacuucugcagcaauucccgcggcucgagcugcucgaucugagaggaaauaaacuucuguuccucaccgacucccugagcgauuuuaccuccucucugcgcacacuucugcucagccauaaccggauuucccaucugccuucuggcuuccucagcgaggucuccucucugaagcaccuugaccugagcuccaaucugcucaagaccaucaacaaaagcgcgcuggaaacaaagacgaccacaaaacuuucuaugcuggagcuccacgggaaucccuuugaaugcaccugugauauuggagacuucagacgcuggauggaugagcaccugaacgugaagaucccucggcucguugacgugauuugcgccucccccggcgaucagagaggcaagagcaucgucucucuggaacuuacaaccuguguguccgacguuacggcugugauccuguuuuucuuuaccuucuuuauuacaaccauggucaugcuggccgcccucgcucaucaccuguucuauugggacgugugguuuaucuacaaugucugccuugccaaagugaagggguaucggagccugucuacaucccagaccuucuacgaugcguauauuagcuacgacacgaaagaugcuuccguuacagacugggugaucaacgagcuccgcuaccaccuggaggaaagcagagauaagaauguccuccugugucuugaggaacgggacugggauccuggacuggccauuaucgacaaccugaugcagucuaucaaucaaagcaagaaaaccguguucguucucacaaagaaauaugccaaguccuggaacuuuaaaaccgcuuucuaccuggcccuucagagacugauggaugagaacauggacgugauuaucuuuauucuccuggaacccguccuccagcauucucaauaucugcgccuucggcagagaaucugcaagagcuccauucugcaguggccggauaauccuaaagcugagggccuguucuggcagacccuccgcaacguggugcugacagagaaugacucuagauacaacaauauguauguugauagcaucaagcaauacuga

SEQ ID NO: 9802 - protein, 1032 aa, Artificial Sequence [sequence omitted]

SEQ ID NO: 9803 - RNA, 3099 nt, Artificial Sequence
  TLR9__Homo_sapiens__ABW37074
auggguuucugccgcagcgcccugcacccgcugucucuccuggugcaggccaucaugcuggccaugacccuggcccuggguaccuugccugccuuccuacccugugagcuccagccccacggccuggugaacugcaacuggcuguuccugaagucugugccccacuucuccacggcagcaccccguggcaaugucaccagccuuuccuuguccuccaaccgcauccaccaccuccaugauucugacuuugcccaccugcccagccugcggcaucucaaccucaaguggaacugcccgccgguuggccucagccccaugcacuuccccugccacaugaccaucgagcccagcaccuucuuggcugugcccacccuggaagagcuaaaccugagcuacaacaacaucaugacugugccugcgcugcccaaaucccucauaucccugucccucagccauaccaacauccugaugcuagacucugccagccucgccggccugcaugcccugcgcuuccuauucauggacggcaacuguuauuacaagaaccccugcaggcaggcacuggagguggccccgggugcccuccuuggccugggcaaccucacccaccugucacucaaguacaacaaccucacuguggugccccgcaaccugccuuccagccuggaguaucugcuguuguccuacaaccgcaucgucaaacuggcgccugaggaccuggccaaucugaccgcccugcgugugcucgaugugggcggaaauugccgccgcugcgaccacgcucccaaccccugcauggagugcccucgucacuucccccagcuacaucccgauaccuucagccaccugagccgucuugaaggccugguguugaaggacaguucucucuccuggcugaaugccaguugguuccgugggcugggaaaccuccgagugcuggaccugagugagaacuuccucuacaaaugcaucacuaaaaccaaggccuuccagggccuaacacagcugcgcaagcuuaaccuguccuucaauuaccaaaagaggguguccuuugcccaccugucucuggccccuuccuucgggagccuggucgcccugaaggagcuggacaugcacggcaucuucuuccgcucacucgaugagaccacgcuccggccacuggcccgccugcccaugcuccagacucugcgucugcagaugaacuucaucaaccaggcccagcucggcaucuucagggccuucccuggccugcgcuacguggaccugucggacaaccgcaucagcggagcuucggagcugacagccaccaugggggaggcagauggaggggagaaggucuggcugcagccuggggaccuugcuccggccccaguggacacucccagcucugaagacuucaggcccaacugcagcacccucaacuucaccuuggaucugucacggaacaaccuggugaccgugcagccggagauguuugcccagcucucgcaccugcagugccugcgccugagccacaacugcaucucgcaggcagucaauggcucccaguuccugccgcugaccggucugcaggugcuagaccugucccacaauaagcuggaccucuaccacgagcacucauucacggagcuaccgcgacuggaggcccuggaccucagcuacaacagccagcccuuuggcaugcagggcgugggccacaacuucagcuucguggcucaccugcgcacccugcgccaccucagccuggcccacaacaacauccacagccaagugucccagcagcucugcaguacgucgcugcgggcccuggacuucagcggcaaugcacugggccauaugugggccgagggagaccucuaucugcacuucuuccaaggccugagcgguuugaucuggcuggacuugucccagaaccgccugcacacccuccugccccaaacccugcgcaaccuccccaagagccuacaggugcugcgucuccgugacaauuaccuggccuucuuuaagugguggagccuccacuuccugcccaaacuggaaguccucgaccuggcaggaaaccagcugaaggcccugaccaauggcagccugccugcuggcacccggcuccggaggcuggaugucagcugcaacagcaucagcuucguggcccccggcuucuuuuccaaggccaaggagcugcgagagcucaaccuuagcgccaacgcccucaagacaguggaccacuccugguuugggccccuggcgagugcccugcaaauacuagauguaagcgccaacccucugcacugcgccuguggggcggccuuuauggacuuccugcuggaggugcaggcugccgugcccggucugcccagccgggugaaguguggcaguccgggccagcuccagggccucagcaucuuugcacaggaccugcgccucugccuggaugaggcccucuccugggacuguuucgcccucucgcugcuggcuguggcucugggccugggugugcccaugcugcaucaccucuguggcugggaccucugguacugcuuccaccugugccuggccuggcuucccuggcgggggcggcaaagugggcgagaugaggaugcccugcccuacgaugccuucguggucuucgacaaaacgcagagcgcaguggcagacuggguguacaacgagcuucgggggcagcuggaggagugccgugggcgcugggcacuccgccugugccuggaggaacgcgacuggcugccuggcaaaacccucuuugagaaccugugggccucggucuauggcagccgcaagacgcuguuugugcuggcccacacggaccgggucaguggucucuugcgcgccagcuuccugcuggcccagcagcgccugcuggaggaccgcaaggacgucguggugcuggugauccugagcccugacggccgccgcucccgcuacgugcggcugcgccagcgccucugccgccagaguguccuccucuggccccaccagcccaguggucagcgcagcuucugggcccagcugggcauggcccugaccagggacaaccaccacuucuauaaccggaacuucugccagggacccacggccgaauag

SEQ ID NO: 9804 - RNA, 3099 nt, Artificial Sequence
  derived and/or modified sequence opt1 from TLR9__Homo_sapiens__ABW37074
augggcuucugccgcagcgcccugcacccccucucccugcuggugcaggccaucaugcucgcgaugacccuggcccuggggacccucccggccuuccugcccugcgagcugcagccccacggccucgucaacugcaacuggcuguuccucaagagcgugccccacuucuccacggccgccccgcgggggaacgugaccagccugucccugagcuccaaccgcauccaccaccuccacgacagcgacuucgcgcaccuccccucccugcggcaccugaaccugaaguggaacugcccgcccgucggccugagccccaugcacuuccccugccacaugaccaucgagcccuccaccuuccuggccgugcccacgcucgaggagcugaaccugagcuacaacaacaucaugaccgugccggcccuccccaagucccugaucagccugucccucagccacaccaacauccugaugcuggacuccgccagccucgcggggcugcacgcccugcgcuuccucuucauggacggcaacugcuacuacaagaaccccugccggcaggcccuggaggucgcccccggcgcccugcucgggcugggcaaccugacccaccucucccugaaguacaacaaccugacgguggugccgcgcaaccuccccagcagccuggaguaccugcuccuguccuacaaccggaucgucaagcuggcgcccgaggaccucgccaaccugaccgcccugcgcgugcuggacgucgggggcaacugccggcgcugcgaccacgcccccaacccgugcauggagugcccccggcacuucccccagcuccaccccgacaccuucagccaccugucccgccuggaggggcucgugcugaaggacagcucccugagcuggcucaacgccuccugguuccggggccugggcaaccugcgcgugcucgaccugagcgagaacuuccuguacaagugcaucaccaagacgaaggcguuccaggggcucacccagcugcggaagcugaaccucuccuucaacuaccagaagcgcgugagcuucgcccaccugucccuggccccgagcuucggcucccucgucgcccugaaggagcuggacaugcacgggaucuucuuccggagccucgacgagaccacccugcgcccccuggcccggcuccccaugcugcagacgcugcgccuccagaugaacuucaucaaccaggcgcagcugggcaucuuccgggccuuccccggccugcgcuacguggaccucuccgacaaccgcaucagcggggccuccgagcugaccgccaccaugggcgaggccgacgggggcgagaagguguggcugcagccgggggaccucgcgcccgcccccgucgacaccccgagcuccgaggacuuccggcccaacugcagcacgcugaacuucacccuggaccucagccgcaacaaccuggugaccgugcagcccgagauguucgcccagcugucccaccuccagugccugcggcugagccacaacugcaucucccaggccgucaacggcagccaguuccucccccugaccggccuccaggugcuggaccugucccacaacaagcuggaccucuaccacgagcacagcuucacggagcugccgcgccuggaggcgcucgaccuguccuacaacagccagcccuucgggaugcagggcguggggcacaacuucuccuucgucgcccaccuccggacccugcgccaccugagccuggcccacaacaacauccacucccaggugagccagcagcucugcuccaccagccugcgggcccuggacuucuccggcaacgcccucgggcacaugugggcggagggcgaccuguaccugcacuucuuccagggccucagcgggcugaucuggcuggaccucucccagaaccgccugcacacccugcucccccagacgcugcggaaccugcccaagagccuccagguccugcgccugcgggacaacuaccucgccuucuucaagugguggagccugcacuuccugccgaagcucgaggugcuggaccuggccggcaaccagcucaaggcccugaccaacgggucccugcccgccggcacccgccuccggcgccuggacgugagcugcaacuccaucagcuucgucgcgcccggguucuucuccaaggccaaggagcugcgggagcucaaccugagcgccaacgcccugaagaccguggaccacuccugguucggcccccucgccagcgcgcugcagauccuggacguguccgccaacccgcuccacugcgccugcggcgccgcguucauggacuuccugcuggagguccaggccgccgugcccgggcugcccagccgcgugaagugcggcucccccgggcagcuccagggccugagcaucuucgcccaggaccugcggcucugccuggacgaggcccuguccugggacugcuucgcgcucagccugcuggccgucgcccucggccugggggugccgaugcugcaccaccucugcggcugggaccugugguacugcuuccaccugugccucgccuggcugcccuggcgcgggcggcaguccggccgcgacgaggacgcccugcccuacgacgcguucguggucuucgacaagacgcagagcgccguggccgacuggguguacaacgagcuccgcgggcagcuggaggagugccggggccgcugggcccugcggcucugccuggaggagcgcgacuggcugcccggcaagacccucuucgagaaccugugggccuccgucuacgggagccggaagacccuguucgugcucgcgcacaccgaccgcguguccggccugcugcgggccagcuuccuccuggcccagcagcgccugcucgaggaccggaaggacgucguggugcuggucauccugagcccggacgggcgccggucccgcuacgugcggcuccgccagcggcugugccgccagagcgugcugcucuggccccaccagcccuccggccagcggagcuucugggcccagcuggggauggcgcugacgcgcgacaaccaccacuucuacaaccggaacuucugccagggccccaccgccgaguga

SEQ ID NO: 9805 - RNA, 3099 nt, Artificial Sequence
  derived and/or modified sequence opt2 from TLR9__Homo_sapiens__ABW37074
augggcuucugccgcuccgcccuccacccccucucccuccucguccaggccaucaugcucgccaugacccucgcccucggcacccuccccgccuuccuccccugcgagcuccagccccacggccucgucaacugcaacuggcucuuccucaaguccgucccccacuucuccaccgccgccccccgcggcaacgucaccucccucucccucuccuccaaccgcauccaccaccuccacgacuccgacuucgcccaccuccccucccuccgccaccucaaccucaaguggaacugcccccccgucggccucucccccaugcacuuccccugccacaugaccaucgagcccuccaccuuccucgccguccccacccucgaggagcucaaccucuccuacaacaacaucaugaccguccccgcccuccccaagucccucaucucccucucccucucccacaccaacauccucaugcucgacuccgccucccucgccggccuccacgcccuccgcuuccucuucauggacggcaacugcuacuacaagaaccccugccgccaggcccucgaggucgcccccggcgcccuccucggccucggcaaccucacccaccucucccucaaguacaacaaccucaccgucgucccccgcaaccuccccuccucccucgaguaccuccuccucuccuacaaccgcaucgucaagcucgcccccgaggaccucgccaaccucaccgcccuccgcguccucgacgucggcggcaacugccgccgcugcgaccacgcccccaaccccugcauggagugcccccgccacuucccccagcuccaccccgacaccuucucccaccucucccgccucgagggccucguccucaaggacuccucccucuccuggcucaacgccuccugguuccgcggccucggcaaccuccgcguccucgaccucuccgagaacuuccucuacaagugcaucaccaagaccaaggccuuccagggccucacccagcuccgcaagcucaaccucuccuucaacuaccagaagcgcgucuccuucgcccaccucucccucgcccccuccuucggcucccucgucgcccucaaggagcucgacaugcacggcaucuucuuccgcucccucgacgagaccacccuccgcccccucgcccgccuccccaugcuccagacccuccgccuccagaugaacuucaucaaccaggcccagcucggcaucuuccgcgccuuccccggccuccgcuacgucgaccucuccgacaaccgcaucuccggcgccuccgagcucaccgccaccaugggcgaggccgacggcggcgagaaggucuggcuccagcccggcgaccucgcccccgcccccgucgacacccccuccuccgaggacuuccgccccaacugcuccacccucaacuucacccucgaccucucccgcaacaaccucgucaccguccagcccgagauguucgcccagcucucccaccuccagugccuccgccucucccacaacugcaucucccaggccgucaacggcucccaguuccucccccucaccggccuccagguccucgaccucucccacaacaagcucgaccucuaccacgagcacuccuucaccgagcucccccgccucgaggcccucgaccucuccuacaacucccagcccuucggcaugcagggcgucggccacaacuucuccuucgucgcccaccuccgcacccuccgccaccucucccucgcccacaacaacauccacucccaggucucccagcagcucugcuccaccucccuccgcgcccucgacuucuccggcaacgcccucggccacaugugggccgagggcgaccucuaccuccacuucuuccagggccucuccggccucaucuggcucgaccucucccagaaccgccuccacacccuccucccccagacccuccgcaaccuccccaagucccuccagguccuccgccuccgcgacaacuaccucgccuucuucaagugguggucccuccacuuccuccccaagcucgagguccucgaccucgccggcaaccagcucaaggcccucaccaacggcucccuccccgccggcacccgccuccgccgccucgacgucuccugcaacuccaucuccuucgucgcccccggcuucuucuccaaggccaaggagcuccgcgagcucaaccucuccgccaacgcccucaagaccgucgaccacuccugguucggcccccucgccuccgcccuccagauccucgacgucuccgccaacccccuccacugcgccugcggcgccgccuucauggacuuccuccucgagguccaggccgccguccccggccuccccucccgcgucaagugcggcucccccggccagcuccagggccucuccaucuucgcccaggaccuccgccucugccucgacgaggcccucuccugggacugcuucgcccucucccuccucgccgucgcccucggccucggcguccccaugcuccaccaccucugcggcugggaccucugguacugcuuccaccucugccucgccuggcuccccuggcgcggccgccaguccggccgcgacgaggacgcccuccccuacgacgccuucgucgucuucgacaagacccaguccgccgucgccgacugggucuacaacgagcuccgcggccagcucgaggagugccgcggccgcugggcccuccgccucugccucgaggagcgcgacuggcuccccggcaagacccucuucgagaaccucugggccuccgucuacggcucccgcaagacccucuucguccucgcccacaccgaccgcgucuccggccuccuccgcgccuccuuccuccucgcccagcagcgccuccucgaggaccgcaaggacgucgucguccucgucauccucucccccgacggccgccgcucccgcuacguccgccuccgccagcgccucugccgccaguccguccuccucuggccccaccagcccuccggccagcgcuccuucugggcccagcucggcauggcccucacccgcgacaaccaccacuucuacaaccgcaacuucugccagggccccaccgccgaguga

SEQ ID NO: 9806 - RNA, 3099 nt, Artificial Sequence
  derived and/or modified sequence opt3 from TLR9__Homo_sapiens__ABW37074
augggcuucugcagaagcgcccugcacccccucucccuucuggugcaggcuaucauguuggcaaugaccuuagcccuggggacacuaccugcguuucucccaugugagcugcaaccgcauggacuugucaacugcaauuggcuguucuugaagucuguuccccacuuuucaacugcugccccuagggguaacgugacgagucucagccuguccucuaaucggauucaucaccuucaugacucggauuucgcacaccucccaucauuacgccaccugaaccuuaaauggaauugucccccuguaggcuugagcccaaugcauuuucccugccacaugaccauagaaccuaguacauuccuggccgugccaacucuagaggaacucaaccuguccuacaauaacaucaugaccgucccggcucugcccaagucucugauuagcuugucccucucacauacaaauauccugauguuagacagugcaagccuggccgggcuccacgcucugcgauuucuguucauggauggaaacuguuauuacaaaaauccuugccgucaggccuuggagguggcgccaggcgcacuacugggucucgggaaccugacccaccuuucucugaaguauaauaacuugacuguugugcccagaaaucucccuuccucacuggaauacuuacugcuaagcuauaacaggauugucaaacucgccccagaggaccuggcuaaccuuacagccuugcgggugcuggauguaggaggcaauugucgcagaugcgaccaugcacccaacccguguauggagugcccuaggcacuuuccccagcuccauccagauaccuucagucaccugucucggcuugaaggccugguuuugaaggacuccagccucucguggcugaaugcuucuugguuucgcggguuaggaaaccugcgagugcuagaucucuccgagaauuuccuguacaaguguaucacgaaaacuaaggccuuucagggucuuacccaauugagaaaacugaaccucucauucaauuaucagaagagggucaguuucgcgcaucugagcuuagccccuuccuuuggcucucugguggcacuuaaagaauuggacaugcacgggauauucuuucggagccucgaugagacaacucugcguccccuagcucgccugccaaugcuccagacccugagacuucagaugaacuucaucaaucaagcccaguugggaauuuuuagggcuuuccccggccugcgguacguggacuuaucagauaaccgaaucaguggugccuccgagcucacagcaaccaugggggaagccgacggaggcgagaaggucuggcugcagccuggcgaccuugcuccagcgccgguugauacgcccagcucugaagacuuucgcccuaauugcucaacucugaacuucacauuggaucucaguagaaauaaccuggugaccguacagccagagauguuugcacaacuaagccaccuucagugccucaggcugucccauaauuguauuucucaggccgugaacgggucgcaauuccuucccuugacuggacugcaggucuuagaccucagccacaacaagcuggaucuuuaccaugaacacuccuuuacagagcugccucggcuagaggcucucgaccugucauauaauagucagccauucgguaugcagggcguggggcacaacuuuucuuucguugcccauuugcgcacccugagacacuuaagccucgcacauaauaacauccacucccaagugucacagcagcugugcagcacgucucuuagggcccuggauuucuccggaaaugcuuugggccauaugugggccgaaggugaccucuaccugcacuuuuuccaggggcuaaguggccugauauggcuugaucucagccaaaaccgucugcacaccuugcugccccagacauuacggaaucucccgaaaucucugcagguccuucgacugagagacaacuauuuggcauuuuucaagugguggucccuccauuuucugccuaaacuagaggugcuggaucuugcgggaaaucagcucaaggcucugacuaacggcucauugccagccgggaccagguuacgccggcuggacguaaguuguaauagcauuucguucguugcacccggauuuuucuccaaagccaaggaacucagagagcugaaccuuucugcuaaugcccugaaaacaguggaccacagcugguuugguccuuuggcaucagcucuacaaauccuggaugucagugccaacccccuccauugcgcguguggcgccgcuuucauggacuuucugcuugaagugcaggcagccgucccaggguuaccuuccagggugaagugcggaucucccggccagcugcagggucucagcauuuucgcucaagauuugcgccugugucucgacgaggcccuguccugggauugcuuugcacuuucacuguuggcgguugcccuagggcugggcgugccaaugcuccaccauuuauguggaugggaccugugguacugcuuccaccuuugucuggcuuggcucccguggcgaggccggcagagcgggcgugaugaggacgccuugccuuaugaugcauucguagucuuugacaagacucagagugcuguggccgauuggguuuacaaugaacugagaggacaacucgaggaaugcaggggucgcugggcacugcggcuuugccuagaggaaagagacuggcugcccggcaaaaccuuguucgagaacuuaugggccucuguguauggguccaggaagacacuguuuguccucgcucacaccgaucgagugagcggacugcuucgcgcgucguuccugcucgcccagcagcgguugcuggaggacagaaaagacguagugguucuagucauccugucaccagauggcaggcguucucgcuacgugcggcucagacagaggcuuugucgacaaagugugcuguuauggccccaucagccuuccggucagcggagcuuuugggcacaguuggggauggcucugacucgcgacaaccaccauuucuacaauagaaacuuuugccaaggcccaacggccgaauga

SEQ ID NO: 9807 - RNA, 3099 nt, Artificial Sequence
  derived and/or modified sequence opt4 from TLR9__Homo_sapiens__ABW37074
augggcuucugcagaagcgcccugcacccccugagccugcuggugcaggccaucaugcuggccaugacccuggcccugggcacccugcccgccuuccugcccugcgagcugcagccccacggccuggugaacugcaacuggcuguuccugaagagcgugccccacuucagcaccgccgcccccagaggcaacgugaccagccugagccugagcagcaacagaauccaccaccugcacgacagcgacuucgcccaccugcccagccugagacaccugaaccugaaguggaacugcccccccgugggccugagccccaugcacuuccccugccacaugaccaucgagcccagcaccuuccuggccgugcccacccuggaggagcugaaccugagcuacaacaacaucaugaccgugcccgcccugcccaagagccugaucagccugagccugagccacaccaacauccugaugcuggacagcgccagccuggccggccugcacgcccugagauuccuguucauggacggcaacugcuacuacaagaaccccugcagacaggcccuggagguggcccccggcgcccugcugggccugggcaaccugacccaccugagccugaaguacaacaaccugaccguggugcccagaaaccugcccagcagccuggaguaccugcugcugagcuacaacagaaucgugaagcuggcccccgaggaccuggccaaccugaccgcccugagagugcuggacgugggcggcaacugcagaagaugcgaccacgcccccaaccccugcauggagugccccagacacuucccccagcugcaccccgacaccuucagccaccugagcagacuggagggccuggugcugaaggacagcagccugagcuggcugaacgccagcugguucagaggccugggcaaccugagagugcuggaccugagcgagaacuuccuguacaagugcaucaccaagaccaaggccuuccagggccugacccagcugagaaagcugaaccugagcuucaacuaccagaagagagugagcuucgcccaccugagccuggcccccagcuucggcagccugguggcccugaaggagcuggacaugcacggcaucuucuucagaagccuggacgagaccacccugagaccccuggccagacugcccaugcugcagacccugagacugcagaugaacuucaucaaccaggcccagcugggcaucuucagagccuuccccggccugagauacguggaccugagcgacaacagaaucagcggcgccagcgagcugaccgccaccaugggcgaggccgacggcggcgagaagguguggcugcagcccggcgaccuggcccccgcccccguggacacccccagcagcgaggacuucagacccaacugcagcacccugaacuucacccuggaccugagcagaaacaaccuggugaccgugcagcccgagauguucgcccagcugagccaccugcagugccugagacugagccacaacugcaucagccaggccgugaacggcagccaguuccugccccugaccggccugcaggugcuggaccugagccacaacaagcuggaccuguaccacgagcacagcuucaccgagcugcccagacuggaggcccuggaccugagcuacaacagccagcccuucggcaugcagggcgugggccacaacuucagcuucguggcccaccugagaacccugagacaccugagccuggcccacaacaacauccacagccaggugagccagcagcugugcagcaccagccugagagcccuggacuucagcggcaacgcccugggccacaugugggccgagggcgaccuguaccugcacuucuuccagggccugagcggccugaucuggcuggaccugagccagaacagacugcacacccugcugccccagacccugagaaaccugcccaagagccugcaggugcugagacugagagacaacuaccuggccuucuucaagugguggagccugcacuuccugcccaagcuggaggugcuggaccuggccggcaaccagcugaaggcccugaccaacggcagccugcccgccggcaccagacugagaagacuggacgugagcugcaacagcaucagcuucguggcccccggcuucuucagcaaggccaaggagcugagagagcugaaccugagcgccaacgcccugaagaccguggaccacagcugguucggcccccuggccagcgcccugcagauccuggacgugagcgccaacccccugcacugcgccugcggcgccgccuucauggacuuccugcuggaggugcaggccgccgugcccggccugcccagcagagugaagugcggcagccccggccagcugcagggccugagcaucuucgcccaggaccugagacugugccuggacgaggcccugagcugggacugcuucgcccugagccugcuggccguggcccugggccugggcgugcccaugcugcaccaccugugcggcugggaccugugguacugcuuccaccugugccuggccuggcugcccuggagaggcagacagagcggcagagacgaggacgcccugcccuacgacgccuucgugguguucgacaagacccagagcgccguggccgacuggguguacaacgagcugagaggccagcuggaggagugcagaggcagaugggcccugagacugugccuggaggagagagacuggcugcccggcaagacccuguucgagaaccugugggccagcguguacggcagcagaaagacccuguucgugcuggcccacaccgacagagugagcggccugcugagagccagcuuccugcuggcccagcagagacugcuggaggacagaaaggacgugguggugcuggugauccugagccccgacggcagaagaagcagauacgugagacugagacagagacugugcagacagagcgugcugcuguggccccaccagcccagcggccagagaagcuucugggcccagcugggcauggcccugaccagagacaaccaccacuucuacaacagaaacuucugccagggccccaccgccgaguga

SEQ ID NO: 9808 - RNA, 3099 nt, Artificial Sequence
  derived and/or modified sequence opt5 from TLR9__Homo_sapiens__ABW37074
augggcuucugcagaagcgcccugcacccccucucccugcuugugcaggcuaucaugcuggccaugacccucgcgcuggggacacuuccugcuuuucugccgugugagcuccaaccccauggacuggucaacugcaauuggcuguuccucaagucuguuccucacuuuagcacggccgcuccccggggcaacgugaccucccugucucuuagcuccaaucgcauucaucaucugcacgacucugauuucgcucaccucccuagccugagacaccuuaaccugaaauggaauugucccccuguggggcucuccccgaugcauuuucccugccacaugacaaucgaaccuagcaccuuccuggccguccccacacuggaggaacucaaccugucuuacaauaacauuaugaccgugccugcucugcccaagucccugaucagccucucucugucccauacaaauauucuuaugcuggacagcgccucucucgcgggacugcacgcccugcgguuucucuucauggauggcaacuguuauuacaaaaauccgugccgccaggcucuggagguugccccuggggcccuucugggacucggcaaccugacccaccuuucccugaaguauaauaaccucacggugguccccagaaaucugccuagcucccuggaauaccuccugcuuucuuauaaccggaucgugaaacuggcccccgaggaccucgcgaaccugaccgcccugcgcguucuugaugugggcgggaauuguagacggugcgaccaugcucccaacccuuguauggagugcccgcgccacuuuccccagcuccauccugauacauucagccaccuguccagacuggaaggacucguccugaaggacagcucucuuuccuggcugaaugccagcugguuucggggccucgggaaccugcgcgugcuggaucuuucugagaauuuccucuacaaguguaucaccaaaacaaaggcuuuucagggacugacccaacugagaaaacucaaccugagcuucaauuaucagaagcggguguccuucgcccaucuuucucuggcccccagcuuuggcucccucgucgcucugaaagaacuggacaugcacgggauuuucuuucgcagccuugaugagacgacacucagaccucuggcgcggcugcccaugcuccagacccugagacuucagaugaacuucaucaaucaagcccagcugggaauuuuucgcgcuuucccgggccuccgguacguugaccugucugauaacagaaucuccggcgccagcgagcugacagccaccaugggggaagcugacggaggcgagaagguguggcuucagccuggggaccucgcccccgcgccuguggauacccccucuuccgaagacuuucgcccuaauugcagcacacugaacuucacgcuggaucucucccggaauaaccuggucaccgugcagcccgagauguuugcucaacuuucucaucugcagugccucagacugagccacaauuguauuucccaggccguuaacggaucucaauuccugccgcuuacaggccuucaggugcucgaccugagccacaacaagcucgaucuguaccaugaacacuccuuuaccgagcuuccucgccuggaggcccucgaccugagcuauaauucucagcccuucgggaugcagggagucggccacaacuuuuccuucguggcucaucugcggacacuuagacaccugagccucgcccauaauaacauccacucucaaguuucccagcagcugugcagcaccucucuccgcgcucuggauuucagcggcaaugcccuugggcauaugugggcggaaggagaccuguaccuccacuuuuuccagggccuguccgggcugauuuggcuugaucugagccaaaaccggcuccacacgcugcucccccagacacugagaaaucuuccuaaaucucuccaggugcugcgccugcgggacaacuaucuggccuuuuucaagugguggucccuucauuuucugccgaaacucgagguccuggaucucgcuggaaaucagcugaaggcccuuaccaacggcagccugcccgcugggaccagacugcggcgccucgacguguccuguaauucuaucagcuucgucgccccuggcuuuuucuccaaagcgaaggaacugagagagcuuaaccugucugccaaugcucucaaaacaguggaccacagcugguuuggaccccuggccuccgcucuccaaauccuggauguuucugccaacccucuucauugcgccuguggcgcugcguucauggacuuucugcuggaagugcaggccgcuguccccgggcucccuagccgggugaagugcggaucccccggccagcugcaggggcuuagcauuuucgcccaagaucugagacucugucuggacgaggcccucucuugggauugcuuugcucugucccuucuggccguugcgcugggacucggcgugccgaugcugcaccaucuuugugggugggaccugugguacugcuuccaccucugucuggcuuggcugccuuggcgcggccggcagagcggaagagaugaggacgcccuccccuaugaugccuucgucguguuugacaagacccagucugcuguggccgauuggguuuacaaugaacuucgcggccaacuggaggaaugcagagggcggugggcgcugcgccucugccuggaggaaagagacuggcuuccuggaaaaacacuguucgagaaccucugggcuuccgucuauggcagccggaagacgcuguuugugcuggcccacaccgaucgcgugucugggcuccuuagagccuccuuccugcuggcucagcagcggcuccuggaggaccgcaaagacgucgugguucuugugauccugagccccgauggaagacggucccgcuacgucagacuccggcagagacugugucgccaaagcgugcugcucuggccgcaucagccuucuggccagcggagcuuuugggcccagcuugggauggcucugacaagagacaaccaccauuucuacaaucgcaacuuuugccaaggccccaccgccgaauga

SEQ ID NO: 9809 - protein, 1032 aa, Artificial Sequence [sequence omitted]

SEQ ID NO: 9810 - RNA, 3099 nt, Artificial Sequence
  TLR9__Homo_sapiens__AAZ95518
auggguuucugccgcagcgcccugcacccgcugucucuccuggugcaggccaucaugcuggccaugacccuggcccuggguaccuugccugccuuccuacccugugagcuccagccccacggccuggugaacugcaacuggcuguuccugaagucugugccccacuucuccauggcagcaccccguggcaaugucaccagccuuuccuuguccuccaaccgcauccaccaccuccaugauucugacuuugcccaccugcccagccugcggcaucucaaccucaaguggaacugcccgccgguuggccucagccccaugcacuuccccugccacaugaccaucgagcccagcaccuucuuggcugugcccacccuggaagagcuaaaccugagcuacaacaacaucaugacugugccugcgcugcccaaaucccucauaucccugucccucagccauaccaacauccugaugcuagacucugccagccucgccggccugcaugcccugcgcuuccuauucauggacggcaacuguuauuacaagaaccccugcaggcaggcacuggagguggccccgggugcccuccuuggccugggcaaccucacccaccugucacucaaguacaacaaccucacuguggugccccgcaaccugccuuccagccuggaguaucugcuguuguccuacaaccgcaucgucaaacuggcgccugaggaccuggccaaucugaccgcccugcgugugcucgaugugggcggaaauugccgccgcugcgaccacgcucccaaccccugcauggagugcccucgucacuucccccagcuacaucccgauaccuucagccaccugagccgucuugaaggccugguguugaaggacaguucucucuccuggcugaaugccaguugguuccgugggcugggaaaccuccgagugcuggaccugagugagaacuuccucuacaaaugcaucacuaaaaccaaggccuuccagggccuaacacagcugcgcaagcuuaaccuguccuucaauuaccaaaagaggguguccuuugcccaccugucucuggccccuuccuucgggagccuggucgcccugaaggagcuggacaugcacggcaucuucuuccgcucacucgaugagaccacacuccggccacuggcccgccugcccaugcuccagacucugcgucugcagaugaacuucaucaaccaggcccagcucggcaucuucagggccuucccuggccugcgcuacguggaccugucggacaaccgcaucagcggagcuucggagcugacagccaccaugggggaggcagauggaggggagaaggucuggcugcagccuggggaccuugcuccggccccaguggacacucccagcucugaagacuucaggcccaacugcagcacccucaacuucaccuuggaucugucacggaacaaccuggugaccgugcagccggagauguuugcccagcucucgcaccugcagugccugcgccugagccacaacugcaucucacaggcagucaauggcucccaguuccugccgcugaccggucugcaggugcuagaccugucccacaauaagcuggaccucuaccacgagcacucauucacggagcuaccgcgacuggaggcccuggaccucagcuacaacagccagcccuuuggcaugcagggcgugggccacaacuucagcuucguggcucaccugcgcacccugcgccaccucagccuggcccacaacaacauccacagccaagugucccagcagcucugcaguacgucgcugcgggcccuggacuucagcggcaaugcacugggccauaugugggccgagggagaccucuaucugcacuucuuccaaggccugagcgguuugaucuggcuggacuugucccagaaccgccugcacacccuccugccccaaacccugcgcaaccuccccaagagccuacaggugcugcgucuccgugacaauuaccuggccuucuuuaagugguggagccuccacuuccugcccaaacuggaaguccucgaccuggcaggaaaccagcugaaggcccugaccaauggcagccugccugcuggcacccggcuccggaggcuggaugucagcugcaacagcaucagcuucguggcccccggcuucuuuuccaaggccaaggagcugcgagagcucaaccuuagcgccaacgcccucaagacaguggaccacuccugguuugggccccuggcgagugcccugcaaauacuagauguaagcgccaacccucugcacugcgccuguggggcggccuuuauggacuuccugcuggaggugcaggcugccgugcccggucugcccagccgggugaaguguggcaguccgggccagcuccagggccucagcaucuuugcacaggaccugcgccucugccuggaugaggcccucuccugggacuguuucgcccucucgcugcuggcuguggcucugggccugggugugcccaugcugcaucaccucuguggcugggaccucugguacugcuuccaccugugccuggccuggcuucccuggcgggggcggcaaagugggcgagaugaggaugcccugcccuacgaugccuucguggucuucgacaaaacgcagagcgcaguggcagacuggguguacaacgagcuucgggggcagcuggaggagugccgugggcgcugggcacuccaccugugccuggaggaacgcgacuggcugccuggcaaaacccucuuugagaaccugugggccucggucuauggcagccgcaagacgcuguuugugcuggcccacacggaccgggucaguggucucuugcgcgccagcuuccugcuggcccagcagcgccugcuggaggaccgcaaggacgucguggugcuggugauccugagcccugacggccgccgcucccgcuacgugcggcugcgccagcgccucugccgccagaguguccuccucuggccccaccagcccaguggucagcgcagcuucugggcccagcugggcauggcccugaccagggacaaccaccacuucuauaaccggaacuucugccagggacccacggccgaauag

SEQ ID NO: 9811 - RNA, 3099 nt, Artificial Sequence
  derived and/or modified sequence opt1 from TLR9__Homo_sapiens__AAZ95518
augggcuucugccgcagcgcccugcacccccucucccugcuggugcaggccaucaugcucgcgaugacccuggcccuggggacccucccggccuuccugcccugcgagcugcagccccacggccucgucaacugcaacuggcuguuccugaaguccgugccccacuucagcauggccgccccgcgggggaacgugacgagccucucccugagcuccaaccgcauccaccaccuccacgacagcgacuucgcgcaccuccccucccugcggcaccugaaccucaaguggaacugcccgcccgucggccugagccccaugcacuuccccugccacaugaccaucgagcccuccaccuuccuggccgugcccacccucgaggagcugaaccugagcuacaacaacaucaugacggugccggcccuccccaagucccugaucagccugucccucagccacaccaacauccugaugcuggacuccgccagccucgcggggcugcacgcccugcgcuuccucuucauggacggcaacugcuacuacaagaaccccugccggcaggcccuggaggucgcccccggcgcccugcucgggcugggcaaccugacccaccucucccugaaguacaacaaccugaccguggugccgcgcaaccuccccagcagccuggaguaccugcuccuguccuacaaccggaucgucaagcuggcgcccgaggaccucgccaaccugacggcccugcgcgugcuggacgucgggggcaacugccggcgcugcgaccacgcccccaacccgugcauggagugcccccggcacuucccccagcuccaccccgacaccuucagccaccugucccgccuggaggggcucgugcugaaggacagcucccugagcuggcucaacgccuccugguuccggggccugggcaaccugcgcgugcucgaccugagcgagaacuuccuguacaagugcaucaccaagaccaaggcguuccaggggcucacgcagcugcggaagcugaaccucuccuucaacuaccagaagcgcgugagcuucgcccaccugucccuggccccgagcuucggcucccucgucgcccugaaggagcuggacaugcacgggaucuucuuccggagccucgacgagaccacccugcgcccccuggcccggcuccccaugcugcagacccugcgccuccagaugaacuucaucaaccaggcgcagcugggcaucuuccgggccuuccccggccugcgcuacguggaccucuccgacaaccgcaucagcggggccuccgagcugacggccaccaugggcgaggccgacgggggcgagaagguguggcugcagccgggggaccucgcgcccgcccccgucgacaccccgagcuccgaggacuuccggcccaacugcagcacccugaacuucacgcuggaccucagccgcaacaaccuggugaccgugcagcccgagauguucgcccagcugucccaccuccagugccugcggcugagccacaacugcaucucccaggccgucaacggcagccaguuccucccccugaccggccuccaggugcuggaccugucccacaacaagcuggaccucuaccacgagcacagcuucaccgagcugccgcgccuggaggcgcucgaccuguccuacaacagccagcccuucgggaugcagggcguggggcacaacuucuccuucgucgcccaccuccggacgcugcgccaccugagccuggcccacaacaacauccacucccaggugagccagcagcucugcuccaccagccugcgggcccuggacuucuccggcaacgcccucgggcacaugugggcggagggcgaccuguaccugcacuucuuccagggccucagcgggcugaucuggcuggaccucucccagaaccgccugcacacccugcucccccagacccugcggaaccugcccaagagccuccagguccugcgccugcgggacaacuaccucgccuucuucaagugguggagccugcacuuccugccgaagcucgaggugcuggaccuggccggcaaccagcucaaggcccugacgaacgggucccugcccgccggcacccgccuccggcgccuggacgugagcugcaacuccaucagcuucgucgcgcccggguucuucuccaaggccaaggagcugcgggagcucaaccugagcgccaacgcccugaagaccguggaccacuccugguucggcccccucgccagcgcgcugcagauccuggacguguccgccaacccgcuccacugcgccugcggcgccgcguucauggacuuccugcuggagguccaggccgccgugcccgggcugcccagccgcgugaagugcggcucccccgggcagcuccagggccugagcaucuucgcccaggaccugcggcucugccuggacgaggcccuguccugggacugcuucgcgcucagccugcuggccgucgcccucggccugggggugccgaugcugcaccaccucugcggcugggaccugugguacugcuuccaccugugccucgccuggcugcccuggcgcgggcggcaguccggccgcgacgaggacgcccugcccuacgacgcguucguggucuucgacaagacccagagcgccguggccgacuggguguacaacgagcuccgcgggcagcuggaggagugccggggccgcugggcccugcaccucugccuggaggagcgggacuggcugcccggcaagacgcuguucgagaaccugugggccuccgucuacgggagccgcaagacccuguucgugcucgcgcacaccgaccggguguccggccugcugcgcgccagcuuccuccuggcccagcagcggcugcucgaggaccgcaaggacgucguggugcuggucauccugagcccggacgggcggcgcucccgguacgugcgccuccggcagcgccugugccggcagagcgugcugcucuggccccaccagcccuccggccagcgcagcuucugggcccagcuggggauggcgcugacccgggacaaccaccacuucuacaaccgcaacuucugccagggccccacggccgaguga

SEQ ID NO: 9812 - RNA, 3099 nt, Artificial Sequence
  derived and/or modified sequence opt2 from TLR9__Homo_sapiens__AAZ95518
augggcuucugccgcuccgcccuccacccccucucccuccucguccaggccaucaugcucgccaugacccucgcccucggcacccuccccgccuuccuccccugcgagcuccagccccacggccucgucaacugcaacuggcucuuccucaaguccgucccccacuucuccauggccgccccccgcggcaacgucaccucccucucccucuccuccaaccgcauccaccaccuccacgacuccgacuucgcccaccuccccucccuccgccaccucaaccucaaguggaacugcccccccgucggccucucccccaugcacuuccccugccacaugaccaucgagcccuccaccuuccucgccguccccacccucgaggagcucaaccucuccuacaacaacaucaugaccguccccgcccuccccaagucccucaucucccucucccucucccacaccaacauccucaugcucgacuccgccucccucgccggccuccacgcccuccgcuuccucuucauggacggcaacugcuacuacaagaaccccugccgccaggcccucgaggucgcccccggcgcccuccucggccucggcaaccucacccaccucucccucaaguacaacaaccucaccgucgucccccgcaaccuccccuccucccucgaguaccuccuccucuccuacaaccgcaucgucaagcucgcccccgaggaccucgccaaccucaccgcccuccgcguccucgacgucggcggcaacugccgccgcugcgaccacgcccccaaccccugcauggagugcccccgccacuucccccagcuccaccccgacaccuucucccaccucucccgccucgagggccucguccucaaggacuccucccucuccuggcucaacgccuccugguuccgcggccucggcaaccuccgcguccucgaccucuccgagaacuuccucuacaagugcaucaccaagaccaaggccuuccagggccucacccagcuccgcaagcucaaccucuccuucaacuaccagaagcgcgucuccuucgcccaccucucccucgcccccuccuucggcucccucgucgcccucaaggagcucgacaugcacggcaucuucuuccgcucccucgacgagaccacccuccgcccccucgcccgccuccccaugcuccagacccuccgccuccagaugaacuucaucaaccaggcccagcucggcaucuuccgcgccuuccccggccuccgcuacgucgaccucuccgacaaccgcaucuccggcgccuccgagcucaccgccaccaugggcgaggccgacggcggcgagaaggucuggcuccagcccggcgaccucgcccccgcccccgucgacacccccuccuccgaggacuuccgccccaacugcuccacccucaacuucacccucgaccucucccgcaacaaccucgucaccguccagcccgagauguucgcccagcucucccaccuccagugccuccgccucucccacaacugcaucucccaggccgucaacggcucccaguuccucccccucaccggccuccagguccucgaccucucccacaacaagcucgaccucuaccacgagcacuccuucaccgagcucccccgccucgaggcccucgaccucuccuacaacucccagcccuucggcaugcagggcgucggccacaacuucuccuucgucgcccaccuccgcacccuccgccaccucucccucgcccacaacaacauccacucccaggucucccagcagcucugcuccaccucccuccgcgcccucgacuucuccggcaacgcccucggccacaugugggccgagggcgaccucuaccuccacuucuuccagggccucuccggccucaucuggcucgaccucucccagaaccgccuccacacccuccucccccagacccuccgcaaccuccccaagucccuccagguccuccgccuccgcgacaacuaccucgccuucuucaagugguggucccuccacuuccuccccaagcucgagguccucgaccucgccggcaaccagcucaaggcccucaccaacggcucccuccccgccggcacccgccuccgccgccucgacgucuccugcaacuccaucuccuucgucgcccccggcuucuucuccaaggccaaggagcuccgcgagcucaaccucuccgccaacgcccucaagaccgucgaccacuccugguucggcccccucgccuccgcccuccagauccucgacgucuccgccaacccccuccacugcgccugcggcgccgccuucauggacuuccuccucgagguccaggccgccguccccggccuccccucccgcgucaagugcggcucccccggccagcuccagggccucuccaucuucgcccaggaccuccgccucugccucgacgaggcccucuccugggacugcuucgcccucucccuccucgccgucgcccucggccucggcguccccaugcuccaccaccucugcggcugggaccucugguacugcuuccaccucugccucgccuggcuccccuggcgcggccgccaguccggccgcgacgaggacgcccuccccuacgacgccuucgucgucuucgacaagacccaguccgccgucgccgacugggucuacaacgagcuccgcggccagcucgaggagugccgcggccgcugggcccuccaccucugccucgaggagcgcgacuggcuccccggcaagacccucuucgagaaccucugggccuccgucuacggcucccgcaagacccucuucguccucgcccacaccgaccgcgucuccggccuccuccgcgccuccuuccuccucgcccagcagcgccuccucgaggaccgcaaggacgucgucguccucgucauccucucccccgacggccgccgcucccgcuacguccgccuccgccagcgccucugccgccaguccguccuccucuggccccaccagcccuccggccagcgcuccuucugggcccagcucggcauggcccucacccgcgacaaccaccacuucuacaaccgcaacuucugccagggccccaccgccgaguga

SEQ ID NO: 9813 - RNA, 3099 nt, Artificial Sequence
  derived and/or modified sequence opt3 from TLR9__Homo_sapiens__AAZ95518
augggcuucugcagaagcgcccugcacccccucucccuucuggugcaggcuaucauguuggcaaugaccuuagcccuggggacacuaccugcguuucucccaugugagcugcaaccgcauggacuugucaacugcaauuggcuguucuugaagucuguuccccacuuuucaauggcugccccuagggguaacgugacuagccucagccuguccucuaaucggauucaucaccuucaugacucggauuucgcacaccucccaucauuacgccaccugaaccuuaaauggaauugucccccuguaggcuugagcccaaugcauuuucccugccacaugacgauagaaccuaguaccuuccuggccgugccaacacuagaggaacucaaccuguccuacaauaacaucaugacugucccggcucugcccaagucucugauuagcuugucccucucacauaccaauauccugauguuagacagugcaagccuggccgggcuccacgcucugcgauuucuguucauggauggaaacuguuauuacaaaaauccuugccgucaggccuuggagguggcgccaggcgcacuacugggucucgggaaccugacacaccuuucucugaaguauaauaacuugaccguugugcccagaaaucucccuuccucacuggaauacuuacugcuaagcuauaacaggauugucaaacucgccccagaggaccuggcuaaccuuacugccuugcgggugcuggauguaggaggcaauugucgcagaugcgaccaugcacccaacccguguauggagugcccuaggcacuuuccccagcuccauccagauacauucagucaccugucucggcuugaaggccugguuuugaaggacuccagccucucguggcugaaugcuucuugguuucgcggguuaggaaaccugcgagugcuagaucucuccgagaauuuccuguacaaguguaucaccaaaacgaaggccuuucagggucuuacucaauugagaaaacugaaccucucauucaauuaucagaagagggucaguuucgcgcaucugagcuuagccccuuccuuuggcucucugguggcacuuaaagaauuggacaugcacgggauauucuuucggagccucgaugagaccacacugcguccccuagcucgccugccaaugcuccagacucugagacuucagaugaacuucaucaaucaagcccaguugggaauuuuuagggcuuuccccggccugcgguacguggacuuaucagauaaccgaaucaguggugccuccgagcucaccgcaacaaugggggaagccgacggaggcgagaaggucuggcugcagccuggcgaccuugcuccagcgccgguugauacccccagcucugaagacuuucgcccuaauugcucaacgcugaacuucacuuuggaucucaguagaaauaaccuggugacaguacagccagagauguuugcacaacuaagccaccuucagugccucaggcugucccauaauuguauuucucaggccgugaacgggucgcaauuccuucccuugaccggacugcaggucuuagaccucagccacaacaagcuggaucuuuaccaugaacacuccuuuacugagcugccucggcuagaggcucucgaccugucauauaauagucagccauucgguaugcagggcguggggcacaacuuuucuuucguugcccauuugcgcacacugagacacuuaagccucgcacauaauaacauccacucccaagugucacagcagcugugcagcaccucucuuagggcccuggauuucuccggaaaugcuuugggccauaugugggccgaaggugaccucuaccugcacuuuuuccaggggcuaaguggccugauauggcuugaucucagccaaaaccgucugcacacguugcugccccagaccuuacggaaucucccgaaaucucugcagguccuucgacugagagacaacuauuuggcauuuuucaagugguggucccuccauuuucugccuaaacuagaggugcuggaucuugcgggaaaucagcucaaggcucugacaaacggcucauugccagccgggacuagguuacgccggcuggacguaaguuguaauagcauuucguucguugcacccggauuuuucuccaaagccaaggaacucagagagcugaaccuuucugcuaaugcccugaaaaccguggaccacagcugguuugguccuuuggcaucagcucuacaaauccuggaugucagugccaacccccuccauugcgcguguggcgccgcuuucauggacuuucugcuugaagugcaggcagccgucccaggguuaccuuccagggugaagugcggaucucccggccagcugcagggucucagcauuuucgcucaagauuugcgccugugucucgacgaggcccuguccugggauugcuuugcacuuucacuguuggcgguugcccuagggcugggcgugccaaugcuccaccauuuauguggaugggaccugugguacugcuuccaccuuugucuggcuuggcucccguggcgaggccggcagagcgggcgugaugaggacgccuugccuuaugaugcauucguagucuuugacaagacacagagugcuguggccgauuggguuuacaaugaacugagaggacaacucgaggaaugcaggggucgcugggcacugcaccuuugccuagaggaacgggacuggcugcccggcaaaacuuuguucgagaacuuaugggccucuguguauggguccagaaagacccuguuuguccucgcucauacagauagggugagcggacugcuucgagcgucguuccugcucgcccagcagcgcuugcuggaggaccggaaagacguagugguucuagucauccugucaccagauggcagaaggucucguuacgugcgccuccggcagagacuuuguaggcaaagugugcuguuauggccccaccagccuuccggucagcgaaguuuuugggcacaguuggggauggcucugacccgggacaaccaucacuucuacaaucgcaacuuuugccaaggcccaacugccgaauga

SEQ ID NO: 9814 - RNA, 3099 nt, Artificial Sequence
  derived and/or modified sequence opt4 from TLR9__Homo_sapiens__AAZ95518
augggcuucugcagaagcgcccugcacccccugagccugcuggugcaggccaucaugcuggccaugacccuggcccugggcacccugcccgccuuccugcccugcgagcugcagccccacggccuggugaacugcaacuggcuguuccugaagagcgugccccacuucagcauggccgcccccagaggcaacgugaccagccugagccugagcagcaacagaauccaccaccugcacgacagcgacuucgcccaccugcccagccugagacaccugaaccugaaguggaacugcccccccgugggccugagccccaugcacuuccccugccacaugaccaucgagcccagcaccuuccuggccgugcccacccuggaggagcugaaccugagcuacaacaacaucaugaccgugcccgcccugcccaagagccugaucagccugagccugagccacaccaacauccugaugcuggacagcgccagccuggccggccugcacgcccugagauuccuguucauggacggcaacugcuacuacaagaaccccugcagacaggcccuggagguggcccccggcgcccugcugggccugggcaaccugacccaccugagccugaaguacaacaaccugaccguggugcccagaaaccugcccagcagccuggaguaccugcugcugagcuacaacagaaucgugaagcuggcccccgaggaccuggccaaccugaccgcccugagagugcuggacgugggcggcaacugcagaagaugcgaccacgcccccaaccccugcauggagugccccagacacuucccccagcugcaccccgacaccuucagccaccugagcagacuggagggccuggugcugaaggacagcagccugagcuggcugaacgccagcugguucagaggccugggcaaccugagagugcuggaccugagcgagaacuuccuguacaagugcaucaccaagaccaaggccuuccagggccugacccagcugagaaagcugaaccugagcuucaacuaccagaagagagugagcuucgcccaccugagccuggcccccagcuucggcagccugguggcccugaaggagcuggacaugcacggcaucuucuucagaagccuggacgagaccacccugagaccccuggccagacugcccaugcugcagacccugagacugcagaugaacuucaucaaccaggcccagcugggcaucuucagagccuuccccggccugagauacguggaccugagcgacaacagaaucagcggcgccagcgagcugaccgccaccaugggcgaggccgacggcggcgagaagguguggcugcagcccggcgaccuggcccccgcccccguggacacccccagcagcgaggacuucagacccaacugcagcacccugaacuucacccuggaccugagcagaaacaaccuggugaccgugcagcccgagauguucgcccagcugagccaccugcagugccugagacugagccacaacugcaucagccaggccgugaacggcagccaguuccugccccugaccggccugcaggugcuggaccugagccacaacaagcuggaccuguaccacgagcacagcuucaccgagcugcccagacuggaggcccuggaccugagcuacaacagccagcccuucggcaugcagggcgugggccacaacuucagcuucguggcccaccugagaacccugagacaccugagccuggcccacaacaacauccacagccaggugagccagcagcugugcagcaccagccugagagcccuggacuucagcggcaacgcccugggccacaugugggccgagggcgaccuguaccugcacuucuuccagggccugagcggccugaucuggcuggaccugagccagaacagacugcacacccugcugccccagacccugagaaaccugcccaagagccugcaggugcugagacugagagacaacuaccuggccuucuucaagugguggagccugcacuuccugcccaagcuggaggugcuggaccuggccggcaaccagcugaaggcccugaccaacggcagccugcccgccggcaccagacugagaagacuggacgugagcugcaacagcaucagcuucguggcccccggcuucuucagcaaggccaaggagcugagagagcugaaccugagcgccaacgcccugaagaccguggaccacagcugguucggcccccuggccagcgcccugcagauccuggacgugagcgccaacccccugcacugcgccugcggcgccgccuucauggacuuccugcuggaggugcaggccgccgugcccggccugcccagcagagugaagugcggcagccccggccagcugcagggccugagcaucuucgcccaggaccugagacugugccuggacgaggcccugagcugggacugcuucgcccugagccugcuggccguggcccugggccugggcgugcccaugcugcaccaccugugcggcugggaccugugguacugcuuccaccugugccuggccuggcugcccuggagaggcagacagagcggcagagacgaggacgcccugcccuacgacgccuucgugguguucgacaagacccagagcgccguggccgacuggguguacaacgagcugagaggccagcuggaggagugcagaggcagaugggcccugcaccugugccuggaggagagagacuggcugcccggcaagacccuguucgagaaccugugggccagcguguacggcagcagaaagacccuguucgugcuggcccacaccgacagagugagcggccugcugagagccagcuuccugcuggcccagcagagacugcuggaggacagaaaggacgugguggugcuggugauccugagccccgacggcagaagaagcagauacgugagacugagacagagacugugcagacagagcgugcugcuguggccccaccagcccagcggccagagaagcuucugggcccagcugggcauggcccugaccagagacaaccaccacuucuacaacagaaacuucugccagggccccaccgccgaguga

SEQ ID NO: 9815 - RNA, 3099 nt, Artificial Sequence
  derived and/or modified sequence opt5 from TLR9__Homo_sapiens__AAZ95518
augggcuucugcagaagcgcccugcacccccucucccugcuugugcaggcuaucaugcuggccaugacccucgcgcuggggacacuuccugcuuuucugccgugugagcuccaaccccauggacuggucaacugcaauuggcuguuccucaagucuguuccucacuuuagcauggccgcuccccggggcaacgugacgucccugucucuuagcuccaaucgcauucaucaucugcacgacucugauuucgcucaccucccuagccugagacaccuuaaccugaaauggaauugucccccuguggggcucuccccgaugcauuuucccugccacaugaccaucgaaccuagcacauuccuggccguccccacccuggaggaacucaaccugucuuacaauaacauuaugacagugccugcucugcccaagucccugaucagccucucucugucccauaccaauauucuuaugcuggacagcgccucucucgcgggacugcacgcccugcgguuucucuucauggauggcaacuguuauuacaaaaauccgugccgccaggcucuggagguugccccuggggcccuucugggacucggcaaccugacacaccuuucccugaaguauaauaaccucaccgugguccccagaaaucugccuagcucccuggaauaccuccugcuuucuuauaaccggaucgugaaacuggcccccgaggaccucgcgaaccugacggcccugcgcguucuugaugugggcgggaauuguagacggugcgaccaugcucccaacccuuguauggagugcccgcgccacuuuccccagcuccauccugauaccuucagccaccuguccagacuggaaggacucguccugaaggacagcucucuuuccuggcugaaugccagcugguuucggggccucgggaaccugcgcgugcuggaucuuucugagaauuuccucuacaaguguaucacaaaaaccaaggcuuuucagggacugacacaacugagaaaacucaaccugagcuucaauuaucagaagcggguguccuucgcccaucuuucucuggcccccagcuuuggcucccucgucgcucugaaagaacuggacaugcacgggauuuucuuucgcagccuugaugagaccacgcucagaccucuggcgcggcugcccaugcuccagacacugagacuucagaugaacuucaucaaucaagcccagcugggaauuuuucgcgcuuucccgggccuccgguacguugaccugucugauaacagaaucuccggcgccagcgagcugaccgccacaaugggggaagcugacggaggcgagaagguguggcuucagccuggggaccucgcccccgcgccuguggauacccccucuuccgaagacuuucgcccuaauugcagcacccugaacuucacacuggaucucucccggaauaaccuggucacggugcagcccgagauguuugcucaacuuucucaucugcagugccucagacugagccacaauuguauuucccaggccguuaacggaucucaauuccugccgcuuaccggccuucaggugcucgaccugagccacaacaagcucgaucuguaccaugaacacuccuuuacagagcuuccucgccuggaggcccucgaccugagcuauaauucucagcccuucgggaugcagggagucggccacaacuuuuccuucguggcucaucugcggacccuuagacaccugagccucgcccauaauaacauccacucucaaguuucccagcagcugugcagcacaucucuccgcgcucuggauuucagcggcaaugcccuugggcauaugugggcggaaggagaccuguaccuccacuuuuuccagggccuguccgggcugauuuggcuugaucugagccaaaaccggcuccacacccugcucccccagacgcugagaaaucuuccuaaaucucuccaggugcugcgccugcgggacaacuaucuggccuuuuucaagugguggucccuucauuuucugccgaaacucgagguccuggaucucgcuggaaaucagcugaaggcccuuacaaacggcagccugcccgcugggaccagacugcggcgccucgacguguccuguaauucuaucagcuucgucgccccuggcuuuuucuccaaagcgaaggaacugagagagcuuaaccugucugccaaugcucucaaaaccguggaccacagcugguuuggaccccuggccuccgcucuccaaauccuggauguuucugccaacccucuucauugcgccuguggcgcugcguucauggacuuucugcuggaagugcaggccgcuguccccgggcucccuagccgggugaagugcggaucccccggccagcugcaggggcuuagcauuuucgcccaagaucugagacucugucuggacgaggcccucucuugggauugcuuugcucugucccuucuggccguugcgcugggacucggcgugccgaugcugcaccaucuuugugggugggaccugugguacugcuuccaccucugucuggcuuggcugccuuggcgcggccggcagagcggaagagaugaggacgcccuccccuaugaugccuucgucguguuugacaagacacagucugcuguggccgauuggguuuacaaugaacuucgcggccaacuggaggaaugcagagggcggugggcgcugcaccucugccuggaggaacgcgacuggcuuccuggaaaaacccuguucgagaaccucugggcuuccgucuauggcagcagaaagacacuguuugugcuggcccauacggaucgggugucugggcuccuucgcgccuccuuccugcuggcucagcagagacuccuggaggaccggaaagacgucgugguucuugugauccugagccccgauggacgcagaucccgguacguccgccucagacagcggcuguguagacaaagcgugcugcucuggccgcaccagccuucuggccagcgcagcuuuugggcccagcuugggauggcucugacccgggacaaccaucacuucuacaauagaaacuuuugccaaggccccacagccgaauga

SEQ ID NO: 9816 - protein, 1032 aa, Artificial Sequence [sequence omitted]

SEQ ID NO: 9817 - RNA, 3099 nt, Artificial Sequence
  TLR9__Homo_sapiens__AAZ95519
auggguuucugccgcagcgcccugcacccgcugucucuccuggugcaggccaucaugcuggccaugacccuggcccuggguaccuugccugccuuccuacccugugagcuccagccccacggccuggugaacugcaacuggcuguuccugaagucugugccccacuucuccauggcagcaccccguggcaaugucaccagccuuuccuuguccuccaaccgcauccaccaccuccaugauucugacuuugcccaccugcccagccugcggcaucucaaccucaaguggaacugcccgccgguuggccucagccccaugcacuuccccugccacaugaccaucgagcccagcaccuucuuggcugugcccacccuggaagagcuaaaccugagcuacaacaacaucaugacugugccugcgcugcccaaaucccucauaucccugucccucagccauaccaacauccugaugcuagacucugccagccucgccggccugcaugcccugcgcuuccuauucauggacggcaacuguuauuacaagaaccccugcaggcaggcacuggagguggccccgggugcccuccuuggccugggcaaccucacccaccugucacucaaguacaacaaccucacuguggugccccgcaaccugccuuccagccuggaguaucugcuguuguccuacaaccgcaucgucaaacuggcgccugaggaccuggccaaucugaccgcccugcgugugcucgaugugggcggaaauugccgccgcugcgaccacgcucccaaccccugcauggagugcccucgucacuucccccagcuacaucccgauaccuucagccaccugagccgucuugaaggccugguguugaaggacaguucucucuccuggcugaaugccaguugguuccgugggcugggaaaccuccaagugcuggaccugagugagaacuuccucuacaaaugcaucacuaaaaccaaggccuuccagggccuaacacagcugcgcaagcuuaaccuguccuucaauuaccaaaagaggguguccuuugcccaccugucucuggccccuuccuucgggagccuggucgcccugaaggagcuggacaugcacggcaucuucuuccgcucacucgaugagaccacgcuccggccacuggcccgccugcccaugcuccagacucugcgucugcagaugaacuucaucaaccaggcccagcucggcaucuucagggccuucccuggccugcgcuacguggaccugucggacaaccgcaucagcggagcuucggagcugacagccaccaugggggaggcagauggaggggagaaggucuggcugcagccuggggaccuugcuccggccccaguggacacucccagcucugaagacuucaggcccaacugcagcacccucaacuucaccuuggaucugucacggaacaaccuggugaccgugcagccggagauguuugcccagcucucgcaccugcagugccugcgccugagccacaacugcaucucgcaggcagucaauggcucccaguuccugccgcugaccggucugcaggugcuagaccugucccacaauaagcuggaccucuaccacgagcacucauucacggagcuaccacgacuggaggcccuggaccucagcuacaacagccagcccuuuggcaugcagggcgugggccacaacuucagcuucguggcucaccugcgcacccugcgccaccucagccuggcccacaacaacauccacagccaagugucccagcagcucugcaguacgucgcugcgggcccuggacuucagcggcaaugcacugggccauaugugggccgagggagaccucuaucugcacuucuuccaaggccugagcgguuugaucuggcuggacuugucccagaaccgccugcacacccuccugccccaaacccugcgcaaccuccccaagagccuacaggugcugcgucuccgugacaauuaccuggccuucuuuaagugguggagccuccacuuccugcccaaacuggaaguccucgaccuggcaggaaaccagcugaaggcccugaccaauggcagccugccugcuggcacccggcuccggaggcuggaugucagcugcaacagcaucagcuucguggcccccggcuucuuuuccaaggccaaggagcugcgagagcucaaccuuagcgccaacgcccucaagacaguggaccacuccugguuugggccccuggcgagugcccugcaaauacuagauguaagcgccaacccucugcacugcgccuguggggcggccuuuauggacuuccugcuggaggugcaggcugccgugcccggucugcccagccgggugaaguguggcaguccgggccagcuccagggccucagcaucuuugcacaggaccugcgccucugccuggaugaggcccucuccugggacuguuucgcccucucgcugcuggcuguggcucugggccugggugugcccaugcugcaucaccucuguggcugggaccucugguacugcuuccaccugugccuggccuggcuucccuggcgggggcggcaaagugggcgagaugaggaugcccugcccuacgaugccuucguggucuucgacaaaacgcagagcgcaguggcagacuggguguacaacgagcuucgggggcagcuggaggagugccgugggcgcugggcacuccgccugugccuggaggaacgcgacuggcugccuggcaaaacccucuuugagaaccugugggccucggucuauggcagccgcaagacgcuguuugugcuggcccacacggaccgggucaguggucucuugcgcgccagcuuccugcuggcccagcagcgccugcuggaggaccgcaaggacgucguggugcuggugauccugagcccugacggccgccgcucccgcuacgugcggcugcgccagcgccucugccgccagaguguccuccucuggccccaccagcccaguggucagcgcagcuucugggcccagcugggcauggcccugaccagggacaaccaccacuucuauaaccggaacuucugccagggacccacggccgaauag

SEQ ID NO: 9818 - RNA, 3099 nt, Artificial Sequence
  derived and/or modified sequence opt1 from TLR9__Homo_sapiens__AAZ95519
augggcuucugccgcagcgcccugcacccccucucccugcuggugcaggccaucaugcucgcgaugacccuggcccuggggacccucccggccuuccugcccugcgagcugcagccccacggccucgucaacugcaacuggcuguuccugaaguccgugccccacuucagcauggccgccccgcgggggaacgugacgagccucucccugagcuccaaccgcauccaccaccuccacgacagcgacuucgcgcaccuccccucccugcggcaccugaaccucaaguggaacugcccgcccgucggccugagccccaugcacuuccccugccacaugaccaucgagcccuccaccuuccuggccgugcccacccucgaggagcugaaccugagcuacaacaacaucaugacggugccggcccuccccaagucccugaucagccugucccucagccacaccaacauccugaugcuggacuccgccagccucgcggggcugcacgcccugcgcuuccucuucauggacggcaacugcuacuacaagaaccccugccggcaggcccuggaggucgcccccggcgcccugcucgggcugggcaaccugacccaccucucccugaaguacaacaaccugaccguggugccgcgcaaccuccccagcagccuggaguaccugcuccuguccuacaaccggaucgucaagcuggcgcccgaggaccucgccaaccugacggcccugcgcgugcuggacgucgggggcaacugccggcgcugcgaccacgcccccaacccgugcauggagugcccccggcacuucccccagcuccaccccgacaccuucagccaccugucccgccuggaggggcucgugcugaaggacagcucccugagcuggcucaacgccuccugguuccggggccugggcaaccuccaggugcuggaccugagcgagaacuuccuguacaagugcaucaccaagaccaaggcguuccaggggcucacgcagcugcgcaagcugaaccucuccuucaacuaccagaagcgggugagcuucgcccaccugucccuggccccgagcuucggcucccucgucgcccugaaggagcuggacaugcacgggaucuucuuccgcagccucgacgagaccacccugcggccccuggcccgccuccccaugcugcagacccugcggcuccagaugaacuucaucaaccaggcgcagcugggcaucuuccgcgccuuccccggccugcgguacguggaccucuccgacaaccgcaucagcggggccuccgagcugacggccaccaugggcgaggccgacgggggcgagaagguguggcugcagccgggggaccucgcgcccgcccccgucgacaccccgagcuccgaggacuuccgccccaacugcagcacccugaacuucacgcuggaccucagccggaacaaccuggugaccgugcagcccgagauguucgcccagcugucccaccuccagugccugcgccugagccacaacugcaucucccaggccgucaacggcagccaguuccucccccugaccggccuccaggugcuggaccugucccacaacaagcuggaccucuaccacgagcacagcuucaccgagcugccgcggcuggaggcgcucgaccuguccuacaacagccagcccuucgggaugcagggcguggggcacaacuucuccuucgucgcccaccuccgcacgcugcggcaccugagccuggcccacaacaacauccacucccaggugagccagcagcucugcuccaccagccugcgcgcccuggacuucuccggcaacgcccucgggcacaugugggcggagggcgaccuguaccugcacuucuuccagggccucagcgggcugaucuggcuggaccucucccagaaccggcugcacacccugcucccccagacccugcgcaaccugcccaagagccuccagguccugcggcugcgcgacaacuaccucgccuucuucaagugguggagccugcacuuccugccgaagcucgaggugcuggaccuggccggcaaccagcucaaggcccugacgaacgggucccugcccgccggcacccggcuccgccggcuggacgugagcugcaacuccaucagcuucgucgcgcccggguucuucuccaaggccaaggagcugcgcgagcucaaccugagcgccaacgcccugaagaccguggaccacuccugguucggcccccucgccagcgcgcugcagauccuggacguguccgccaacccgcuccacugcgccugcggcgccgcguucauggacuuccugcuggagguccaggccgccgugcccgggcugcccagccgggugaagugcggcucccccgggcagcuccagggccugagcaucuucgcccaggaccugcgccucugccuggacgaggcccuguccugggacugcuucgcgcucagccugcuggccgucgcccucggccugggggugccgaugcugcaccaccucugcggcugggaccugugguacugcuuccaccugugccucgccuggcugcccuggcgggggcgccaguccggccgggacgaggacgcccugcccuacgacgcguucguggucuucgacaagacccagagcgccguggccgacuggguguacaacgagcuccgcgggcagcuggaggagugccgcggccggugggcccugcgccucugccuggaggagcgggacuggcugcccggcaagacgcuguucgagaaccugugggccuccgucuacgggagccgcaagacccuguucgugcucgcgcacaccgaccggguguccggccugcugcgcgccagcuuccuccuggcccagcagcggcugcucgaggaccgcaaggacgucguggugcuggucauccugagcccggacgggcggcgcucccgguacgugcgccuccggcagcgccugugccggcagagcgugcugcucuggccccaccagcccuccggccagcgcagcuucugggcccagcuggggauggcgcugacccgggacaaccaccacuucuacaaccgcaacuucugccagggccccacggccgaguga

SEQ ID NO: 9819 - RNA, 3099 nt, Artificial Sequence
  derived and/or modified sequence opt2 from TLR9__Homo_sapiens__AAZ95519
augggcuucugccgcuccgcccuccacccccucucccuccucguccaggccaucaugcucgccaugacccucgcccucggcacccuccccgccuuccuccccugcgagcuccagccccacggccucgucaacugcaacuggcucuuccucaaguccgucccccacuucuccauggccgccccccgcggcaacgucaccucccucucccucuccuccaaccgcauccaccaccuccacgacuccgacuucgcccaccuccccucccuccgccaccucaaccucaaguggaacugcccccccgucggccucucccccaugcacuuccccugccacaugaccaucgagcccuccaccuuccucgccguccccacccucgaggagcucaaccucuccuacaacaacaucaugaccguccccgcccuccccaagucccucaucucccucucccucucccacaccaacauccucaugcucgacuccgccucccucgccggccuccacgcccuccgcuuccucuucauggacggcaacugcuacuacaagaaccccugccgccaggcccucgaggucgcccccggcgcccuccucggccucggcaaccucacccaccucucccucaaguacaacaaccucaccgucgucccccgcaaccuccccuccucccucgaguaccuccuccucuccuacaaccgcaucgucaagcucgcccccgaggaccucgccaaccucaccgcccuccgcguccucgacgucggcggcaacugccgccgcugcgaccacgcccccaaccccugcauggagugcccccgccacuucccccagcuccaccccgacaccuucucccaccucucccgccucgagggccucguccucaaggacuccucccucuccuggcucaacgccuccugguuccgcggccucggcaaccuccagguccucgaccucuccgagaacuuccucuacaagugcaucaccaagaccaaggccuuccagggccucacccagcuccgcaagcucaaccucuccuucaacuaccagaagcgcgucuccuucgcccaccucucccucgcccccuccuucggcucccucgucgcccucaaggagcucgacaugcacggcaucuucuuccgcucccucgacgagaccacccuccgcccccucgcccgccuccccaugcuccagacccuccgccuccagaugaacuucaucaaccaggcccagcucggcaucuuccgcgccuuccccggccuccgcuacgucgaccucuccgacaaccgcaucuccggcgccuccgagcucaccgccaccaugggcgaggccgacggcggcgagaaggucuggcuccagcccggcgaccucgcccccgcccccgucgacacccccuccuccgaggacuuccgccccaacugcuccacccucaacuucacccucgaccucucccgcaacaaccucgucaccguccagcccgagauguucgcccagcucucccaccuccagugccuccgccucucccacaacugcaucucccaggccgucaacggcucccaguuccucccccucaccggccuccagguccucgaccucucccacaacaagcucgaccucuaccacgagcacuccuucaccgagcucccccgccucgaggcccucgaccucuccuacaacucccagcccuucggcaugcagggcgucggccacaacuucuccuucgucgcccaccuccgcacccuccgccaccucucccucgcccacaacaacauccacucccaggucucccagcagcucugcuccaccucccuccgcgcccucgacuucuccggcaacgcccucggccacaugugggccgagggcgaccucuaccuccacuucuuccagggccucuccggccucaucuggcucgaccucucccagaaccgccuccacacccuccucccccagacccuccgcaaccuccccaagucccuccagguccuccgccuccgcgacaacuaccucgccuucuucaagugguggucccuccacuuccuccccaagcucgagguccucgaccucgccggcaaccagcucaaggcccucaccaacggcucccuccccgccggcacccgccuccgccgccucgacgucuccugcaacuccaucuccuucgucgcccccggcuucuucuccaaggccaaggagcuccgcgagcucaaccucuccgccaacgcccucaagaccgucgaccacuccugguucggcccccucgccuccgcccuccagauccucgacgucuccgccaacccccuccacugcgccugcggcgccgccuucauggacuuccuccucgagguccaggccgccguccccggccuccccucccgcgucaagugcggcucccccggccagcuccagggccucuccaucuucgcccaggaccuccgccucugccucgacgaggcccucuccugggacugcuucgcccucucccuccucgccgucgcccucggccucggcguccccaugcuccaccaccucugcggcugggaccucugguacugcuuccaccucugccucgccuggcuccccuggcgcggccgccaguccggccgcgacgaggacgcccuccccuacgacgccuucgucgucuucgacaagacccaguccgccgucgccgacugggucuacaacgagcuccgcggccagcucgaggagugccgcggccgcugggcccuccgccucugccucgaggagcgcgacuggcuccccggcaagacccucuucgagaaccucugggccuccgucuacggcucccgcaagacccucuucguccucgcccacaccgaccgcgucuccggccuccuccgcgccuccuuccuccucgcccagcagcgccuccucgaggaccgcaaggacgucgucguccucgucauccucucccccgacggccgccgcucccgcuacguccgccuccgccagcgccucugccgccaguccguccuccucuggccccaccagcccuccggccagcgcuccuucugggcccagcucggcauggcccucacccgcgacaaccaccacuucuacaaccgcaacuucugccagggccccaccgccgaguga

SEQ ID NO: 9820 - RNA, 3099 nt, Artificial Sequence
  derived and/or modified sequence opt3 from TLR9__Homo_sapiens__AAZ95519
augggcuucugcagaagcgcccugcacccccucucccuucuggugcaggcuaucauguuggcaaugaccuuagcccuggggacacuaccugcguuucucccaugugagcugcaaccgcauggacuugucaacugcaauuggcuguucuugaagucuguuccccacuuuucaauggcugccccuagggguaacgugacuagccucagccuguccucuaaucggauucaucaccuucaugacucggauuucgcacaccucccaucauuacgccaccugaaccuuaaauggaauugucccccuguaggcuugagcccaaugcauuuucccugccacaugacgauagaaccuaguaccuuccuggccgugccaacacuagaggaacucaaccuguccuacaauaacaucaugacugucccggcucugcccaagucucugauuagcuugucccucucacauaccaauauccugauguuagacagugcaagccuggccgggcuccacgcucugcgauuucuguucauggauggaaacuguuauuacaaaaauccuugccgucaggccuuggagguggcgccaggcgcacuacugggucucgggaaccugacacaccuuucucugaaguauaauaacuugaccguugugcccagaaaucucccuuccucacuggaauacuuacugcuaagcuauaacaggauugucaaacucgccccagaggaccuggcuaaccuuacugccuugcgggugcuggauguaggaggcaauugucgcagaugcgaccaugcacccaacccguguauggagugcccuaggcacuuuccccagcuccauccagauacauucagucaccugucucggcuugaaggccugguuuugaaggacuccagccucucguggcugaaugcuucuugguuucgcggguuaggaaaccuucaggugcuagaucucuccgagaauuuccuguacaaguguaucaccaaaacgaaggccuuucaaggucuuacucaguugcgaaaacugaaccucucauucaauuaucagaagagagucaguuucgcgcaucugagcuuagccccuuccuuuggcucucugguggcacuuaaagaauuggacaugcacgggauauucuuuaggagccucgaugagaccacacugcggccccuagcucgucugccaaugcuccagacucugcgccuucaaaugaacuucaucaaucaggcccaguugggaauuuuuagagcuuuccccggccugagguacguggacuuaucagauaaccggaucaguggugccuccgagcucaccgcaacaaugggggaagccgacggaggcgagaaggucuggcugcagccuggcgaccuugcuccagcgccgguugauacccccagcucugaagacuuucgaccuaauugcucaacgcugaacuucacuuuggaucucagucgcaauaaccuggugacaguacaaccagagauguuugcacagcuaagccaucugcagugccucagacugucccacaauuguauuucucaagccgugaacgggucgcaguuccuucccuugaccggacugcaggucuuagaccucagccacaacaagcuggaucuuuaccaugaacacuccuuuacugagcugccuaggcuagaggcucucgaccugucauauaauagucagccauucgguaugcaaggcguggggcacaacuuuucuuucguugcccauuugcggacacugcgccacuuaagccucgcacauaauaacauccacucccaggugucacagcagcugugcagcaccucucuuagagcccuggauuucuccggaaaugcuuugggccauaugugggccgaaggugaccucuaccugcacuuuuuccaagggcuaaguggccugauauggcuugaucucagccagaacaggcugcacacguugcugccccagaccuuacguaaucucccgaaaucucugcagguccuucggcugcgagacaacuauuuggcauuuuucaagugguggucccuccauuuucugccuaaacuagaggugcuggaucuugcgggaaaucaacucaaggcucugacaaacggcucauugccagccgggacuagauuaaggcgccuggacguaaguuguaauagcauuucguucguugcacccggauuuuucuccaaagccaaggaacuccgggagcugaaccuuucugcuaaugcccugaaaaccguggaccacagcugguuugguccuuuggcaucagcucuacagauccuggaugucagugccaacccccuccauugcgcguguggcgccgcuuucauggacuuucugcuugaagugcaggcagccgucccaggguuaccuuccagagugaagugcggaucucccggccagcugcaaggucucagcauuuucgcucaggauuugaggcugugucucgacgaggcccuguccugggauugcuuugcacuuucacuguuggcgguugcccuagggcugggcgugccaaugcuccaccauuuauguggaugggaccugugguacugcuuccaccuuugucuggcuuggcucccguggcgcggccgacagagcgggcgggaugaggacgccuugccuuaugaugcauucguagucuuugacaagacacaaagugcuguggccgauuggguuuacaaugaacugcguggacagcucgaggaaugcagagguaggugggcacugcgccuuugccuagaggaacgggacuggcugcccggcaaaacuuuguucgagaacuuaugggccucuguguauggguccagaaagacccuguuuguccucgcucacacagauagggugagcggacugcuucgagcgucguuccugcucgcccagcagcgcuugcuggaggaccggaaagacguagugguucuagucauccugucaccagauggcagaaggucucguuacgugcgccuccggcaaagacuuuguaggcagagugugcuguuauggccccaucagccuuccggucagcgaaguuuuugggcacaauuggggauggcucugacccgggacaaccaccauuucuacaaucgcaacuuuugccagggcccaacugccgaauga

SEQ ID NO: 9821 - RNA, 3099 nt, Artificial Sequence
  derived and/or modified sequence opt4 from TLR9__Homo_sapiens__AAZ95519
augggcuucugcagaagcgcccugcacccccugagccugcuggugcaggccaucaugcuggccaugacccuggcccugggcacccugcccgccuuccugcccugcgagcugcagccccacggccuggugaacugcaacuggcuguuccugaagagcgugccccacuucagcauggccgcccccagaggcaacgugaccagccugagccugagcagcaacagaauccaccaccugcacgacagcgacuucgcccaccugcccagccugagacaccugaaccugaaguggaacugcccccccgugggccugagccccaugcacuuccccugccacaugaccaucgagcccagcaccuuccuggccgugcccacccuggaggagcugaaccugagcuacaacaacaucaugaccgugcccgcccugcccaagagccugaucagccugagccugagccacaccaacauccugaugcuggacagcgccagccuggccggccugcacgcccugagauuccuguucauggacggcaacugcuacuacaagaaccccugcagacaggcccuggagguggcccccggcgcccugcugggccugggcaaccugacccaccugagccugaaguacaacaaccugaccguggugcccagaaaccugcccagcagccuggaguaccugcugcugagcuacaacagaaucgugaagcuggcccccgaggaccuggccaaccugaccgcccugagagugcuggacgugggcggcaacugcagaagaugcgaccacgcccccaaccccugcauggagugccccagacacuucccccagcugcaccccgacaccuucagccaccugagcagacuggagggccuggugcugaaggacagcagccugagcuggcugaacgccagcugguucagaggccugggcaaccugcaggugcuggaccugagcgagaacuuccuguacaagugcaucaccaagaccaaggccuuccagggccugacccagcugagaaagcugaaccugagcuucaacuaccagaagagagugagcuucgcccaccugagccuggcccccagcuucggcagccugguggcccugaaggagcuggacaugcacggcaucuucuucagaagccuggacgagaccacccugagaccccuggccagacugcccaugcugcagacccugagacugcagaugaacuucaucaaccaggcccagcugggcaucuucagagccuuccccggccugagauacguggaccugagcgacaacagaaucagcggcgccagcgagcugaccgccaccaugggcgaggccgacggcggcgagaagguguggcugcagcccggcgaccuggcccccgcccccguggacacccccagcagcgaggacuucagacccaacugcagcacccugaacuucacccuggaccugagcagaaacaaccuggugaccgugcagcccgagauguucgcccagcugagccaccugcagugccugagacugagccacaacugcaucagccaggccgugaacggcagccaguuccugccccugaccggccugcaggugcuggaccugagccacaacaagcuggaccuguaccacgagcacagcuucaccgagcugcccagacuggaggcccuggaccugagcuacaacagccagcccuucggcaugcagggcgugggccacaacuucagcuucguggcccaccugagaacccugagacaccugagccuggcccacaacaacauccacagccaggugagccagcagcugugcagcaccagccugagagcccuggacuucagcggcaacgcccugggccacaugugggccgagggcgaccuguaccugcacuucuuccagggccugagcggccugaucuggcuggaccugagccagaacagacugcacacccugcugccccagacccugagaaaccugcccaagagccugcaggugcugagacugagagacaacuaccuggccuucuucaagugguggagccugcacuuccugcccaagcuggaggugcuggaccuggccggcaaccagcugaaggcccugaccaacggcagccugcccgccggcaccagacugagaagacuggacgugagcugcaacagcaucagcuucguggcccccggcuucuucagcaaggccaaggagcugagagagcugaaccugagcgccaacgcccugaagaccguggaccacagcugguucggcccccuggccagcgcccugcagauccuggacgugagcgccaacccccugcacugcgccugcggcgccgccuucauggacuuccugcuggaggugcaggccgccgugcccggccugcccagcagagugaagugcggcagccccggccagcugcagggccugagcaucuucgcccaggaccugagacugugccuggacgaggcccugagcugggacugcuucgcccugagccugcuggccguggcccugggccugggcgugcccaugcugcaccaccugugcggcugggaccugugguacugcuuccaccugugccuggccuggcugcccuggagaggcagacagagcggcagagacgaggacgcccugcccuacgacgccuucgugguguucgacaagacccagagcgccguggccgacuggguguacaacgagcugagaggccagcuggaggagugcagaggcagaugggcccugagacugugccuggaggagagagacuggcugcccggcaagacccuguucgagaaccugugggccagcguguacggcagcagaaagacccuguucgugcuggcccacaccgacagagugagcggccugcugagagccagcuuccugcuggcccagcagagacugcuggaggacagaaaggacgugguggugcuggugauccugagccccgacggcagaagaagcagauacgugagacugagacagagacugugcagacagagcgugcugcuguggccccaccagcccagcggccagagaagcuucugggcccagcugggcauggcccugaccagagacaaccaccacuucuacaacagaaacuucugccagggccccaccgccgaguga

SEQ ID NO: 9822 - RNA, 3099 nt, Artificial Sequence
  derived and/or modified sequence opt5 from TLR9__Homo_sapiens__AAZ95519
augggcuucugcagaagcgcccugcacccccucucccugcuugugcaggcuaucaugcuggccaugacccucgcgcuggggacacuuccugcuuuucugccgugugagcuccaaccccauggacuggucaacugcaauuggcuguuccucaagucuguuccucacuuuagcauggccgcuccccggggcaacgugacgucccugucucuuagcuccaaucgcauucaucaucugcacgacucugauuucgcucaccucccuagccugagacaccuuaaccugaaauggaauugucccccuguggggcucuccccgaugcauuuucccugccacaugaccaucgaaccuagcacauuccuggccguccccacccuggaggaacucaaccugucuuacaauaacauuaugacagugccugcucugcccaagucccugaucagccucucucugucccauaccaauauucuuaugcuggacagcgccucucucgcgggacugcacgcccugcgguuucucuucauggauggcaacuguuauuacaaaaauccgugccgccaggcucuggagguugccccuggggcccuucugggacucggcaaccugacacaccuuucccugaaguauaauaaccucaccgugguccccagaaaucugccuagcucccuggaauaccuccugcuuucuuauaaccggaucgugaaacuggcccccgaggaccucgcgaaccugacggcccugcgcguucuugaugugggcgggaauuguagacggugcgaccaugcucccaacccuuguauggagugcccgcgccacuuuccccagcuccauccugauaccuucagccaccuguccagacuggaaggacucguccugaaggacagcucucuuuccuggcugaaugccagcugguuucggggccucgggaaccuucaggugcuggaucuuucugagaauuuccucuacaaguguaucacaaaaaccaaggcuuuucaaggacugacacagcugcgcaaacucaaccugagcuucaauuaucagaagagaguguccuucgcccaucuuucucuggcccccagcuuuggcucccucgucgcucugaaagaacuggacaugcacgggauuuucuuucggagccuugaugagaccacgcuccgcccucuggcgagacugcccaugcuccagacacugcggcuucaaaugaacuucaucaaucaggcccagcugggaauuuuuagagcuuucccgggccuccgcuacguugaccugucugauaaccggaucuccggcgccagcgagcugaccgccacaaugggggaagcugacggaggcgagaagguguggcuucagccuggggaccucgcccccgcgccuguggauacccccucuuccgaagacuuuagaccuaauugcagcacccugaacuucacacuggaucucucccgcaauaaccuggucacggugcaacccgagauguuugcucagcuuucucaucugcagugccuccggcugagccacaauuguauuucccaagccguuaacggaucucaguuccugccgcuuaccggccuccaggugcuggaccugagccacaacaagcucgaucuguaccaugaacacuccuuuacagagcuuccuagacuggaggcccucgaccugagcuauaauucucagcccuucgggaugcaaggagucggccacaacuuuuccuucguggcucaucugcgcacccuucggcaccugagccucgcccauaauaacauccacucucagguuucccagcagcugugcagcacaucucucagagcucuggauuucagcggcaaugcccuugggcauaugugggcggaaggagaccuguaccuccacuuuuuccaaggccuguccgggcugauuuggcuugaucugagccagaaccgccuccacacccugcucccccagacgcugcggaaucuuccuaaaucucuccaggugcugagacugcgcgacaacuaucuggccuuuuucaagugguggucccuucauuuucugccgaaacucgagguccuggaucucgcuggaaaucaacugaaggcccuuacaaacggcagccugcccgcugggacccggcugagacggcucgacguguccuguaauucuaucagcuucgucgccccuggcuuuuucuccaaagcgaaggaacugcgcgagcuuaaccugucugccaaugcucucaaaaccguggaccacagcugguuuggaccccuggccuccgcucuccagauccuggauguuucugccaacccucuucauugcgccuguggcgcugcguucauggacuuucugcuggaagugcaggccgcuguccccgggcucccuagcagagugaagugcggaucccccggccagcugcaagggcuuagcauuuucgcccaggaucugcggcucugucuggacgaggcccucucuugggauugcuuugcucugucccuucuggccguugcgcugggacucggcgugccgaugcugcaccaucuuugugggugggaccugugguacugcuuccaccucugucuggcuuggcugccuuggagaggccgccagagcggacgggaugaggacgcccuccccuaugaugccuucgucguguuugacaagacacaaucugcuguggccgauuggguuuacaaugaacuuagaggccagcuggaggaaugccgcgggagaugggcgcugcggcucugccuggaggaacgcgacuggcuuccuggaaaaacccuguucgagaaccucugggcuuccgucuauggcagcagaaagacacuguuugugcuggcccacacggaucgggugucugggcuccuucgcgccuccuuccugcuggcucagcagagacuccuggaggaccggaaagacgucgugguucuugugauccugagccccgauggacgcagaucccgguacguccgccucagacaacggcuguguagacagagcgugcugcucuggccgcaucagccuucuggccagcgcagcuuuugggcccaacuugggauggcucugacccgggacaaccaccauuucuacaauagaaacuuuugccagggccccacagccgaauga

SEQ ID NO: 9823 - protein, 78 aa, Artificial Sequence
  TLR9__Homo_sapiens__L0R5D6
MRPCRTLEMVPTRAEKDKSAAAVLRAPAVVQEPRPEGGSVLLEWGVPSKVYPLLVLSRIPISPCSLPELWALAPPWAW

SEQ ID NO: 9824 - RNA, 237 nt, Artificial Sequence
  TLR9__Homo_sapiens__CCO13834
augaggcccugcagaacucuggagauggugccuacaagggcagaaaaggacaagucggcagccgcuguccugagggcaccagcuguggugcaggagccaagaccugaggguggaaguguccucuuagaauggggagugcccagcaagguguacccgcuacuggugcuauccagaauucccaucucucccugcucucugccugagcucugggccuuagcuccucccugggcuugguag

SEQ ID NO: 9825 - RNA, 237 nt, Artificial Sequence
  derived and/or modified sequence opt1 from TLR9__Homo_sapiens__CCO13834
augcgccccugccggacccuggagauggugcccacccgcgccgagaaggacaagagcgccgcggccguccuccgggcccccgccguggugcaggagccccgccccgagggcggguccguccugcuggaguggggcgugccgagcaagguguacccccuccugguccugucccggauccccaucagccccugcucccucccggagcugugggcccuggcgccgcccugggccugguga

SEQ ID NO: 9826 - RNA, 237 nt, Artificial Sequence
  derived and/or modified sequence opt2 from TLR9__Homo_sapiens__CCO13834
augcgccccugccgcacccucgagaugguccccacccgcgccgagaaggacaaguccgccgccgccguccuccgcgcccccgccgucguccaggagccccgccccgagggcggcuccguccuccucgaguggggcguccccuccaaggucuacccccuccucguccucucccgcauccccaucucccccugcucccuccccgagcucugggcccucgccccccccugggccugguga

SEQ ID NO: 9827 - RNA, 237 nt, Artificial Sequence
  derived and/or modified sequence opt3 from TLR9__Homo_sapiens__CCO13834
augagacccugcaggacccuggagauggugccuacacgggccgaaaaggacaaaagcgcugcagccguccuccgcgcgccagcuguugugcaggagccgcgacccgaaggcggguccguacuucuggaguggggagugccuucuaaggucuacccauuguuagugcugucacguauccccauuaguccuuguagccuaccagaacucugggcccuggcacccccuugggccugguga

SEQ ID NO: 9828 - RNA, 237 nt, Artificial Sequence
  derived and/or modified sequence opt4 from TLR9__Homo_sapiens__CCO13834
augagacccugcagaacccuggagauggugcccaccagagccgagaaggacaagagcgccgccgccgugcugagagcccccgccguggugcaggagcccagacccgagggcggcagcgugcugcuggaguggggcgugcccagcaagguguacccccugcuggugcugagcagaauccccaucagccccugcagccugcccgagcugugggcccuggccccccccugggccugguga

SEQ ID NO: 9829 - RNA, 237 nt, Artificial Sequence
  derived and/or modified sequence opt5 from TLR9__Homo_sapiens__CCO13834
augagacccugccggacccuggagauggugccuacacgcgccgaaaaggacaaaagcgcugccgcgguccucagagcuccggccguugugcaggagccccggccugaaggcggguccgugcugcuugaguggggaguccccucuaagguguacccucugcucguucugagccgcauccccauuuccccuuguucucuuccggaacugugggcccucgcucccccuugggccugguga

SEQ ID NO: 9830 - protein, 44 aa, Artificial Sequence
  TLR9__Homo_sapiens__L8E8B9
MEGRRSGCSLGTLLRPQWTLPALKTSGPTAAPSTSPWICHGTTW

SEQ ID NO: 9831 - RNA, 135 nt, Artificial Sequence
  TLR9__Homo_sapiens__CCQ43550
auggaggggagaaggucuggcugcagccuggggaccuugcuccggccccaguggacacucccagcucugaagacuucaggcccaacugcagcacccucaacuucaccuuggaucugucacggaacaaccugguga

SEQ ID NO: 9832 - RNA, 135 nt, Artificial Sequence
  derived and/or modified sequence opt1 from TLR9__Homo_sapiens__CCQ43550
auggagggccgccggagcgggugcucccugggcacccuccugcgcccccaguggacccugccggcccucaagacgagcgggcccaccgccgcgcccuccaccagccccuggaucugccacggcaccacgugguga

SEQ ID NO: 9833 - RNA, 135 nt, Artificial Sequence
  derived and/or modified sequence opt2 from TLR9__Homo_sapiens__CCQ43550
auggagggccgccgcuccggcugcucccucggcacccuccuccgcccccaguggacccuccccgcccucaagaccuccggccccaccgccgcccccuccaccucccccuggaucugccacggcaccaccugguga

SEQ ID NO: 9834 - RNA, 135 nt, Artificial Sequence
  derived and/or modified sequence opt3 from TLR9__Homo_sapiens__CCQ43550
auggagggcagaaggagcgggugcucccugggaacccuccuucggccccaguggacacugccugccuugaagacuucugguccaacggcugcaccgucaaccagucccuggaucugucacggcacaacuugguga

SEQ ID NO: 9835 - RNA, 135 nt, Artificial Sequence
  derived and/or modified sequence opt4 from TLR9__Homo_sapiens__CCQ43550
auggagggcagaagaagcggcugcagccugggcacccugcugagaccccaguggacccugcccgcccugaagaccagcggccccaccgccgcccccagcaccagccccuggaucugccacggcaccaccugguga

SEQ ID NO: 9836 - RNA, 135 nt, Artificial Sequence
  derived and/or modified sequence opt5 from TLR9__Homo_sapiens__CCQ43550
auggagggcagacggagcgggugcucccugggaacccuccugcgcccccaguggacacuuccugcccugaagacgucuggcccgaccgcugcccccagcacauccccuuggaucugucacgggaccacaugguga

SEQ ID NO: 9837 - protein, 1032 aa, Artificial Sequence
  TLR9__Homo_sapiens__Q9NR96
MGFCRSALHPLSLLVQAIMLAMTLALGTLPAFLPCELQPHGLVNCNWLFLKSVPHFSMAAPRGNVTSLSLSSNRIHHLHDSDFAHLPSLRHLNLKWNCPPVGLSPMHFPCHMTIEPSTFLAVPTLEELNLSYNNIMTVPALPKSLISLSLSHTNILMLDSASLAGLHALRFLFMDGNCYYKNPCRQALEVAPGALLGLGNLTHLSLKYNNLTVVPRNLPSSLEYLLLSYNRIVKLAPEDLANLTALRVLDVGGNCRRCDHAPNPCMECPRHFPQLHPDTFSHLSRLEGLVLKDSSLSWLNASWFRGLGNLRVLDLSENFLYKCITKTKAFQGLTQLRKLNLSFNYQKRVSFAHLSLAPSFGSLVALKELDMHGIFFRSLDETTLRPLARLPMLQTLRLQMNFINQAQLGIFRAFPGLRYVDLSDNRISGASELTATMGEADGGEKVWLQPGDLAPAPVDTPSSEDFRPNCSTLNFTLDLSRNNLVTVQPEMFAQLSHLQCLRLSHNCISQAVNGSQFLPLTGLQVLDLSHNKLDLYHEHSFTELPRLEALDLSYNSQPFGMQGVGHNFSFVAHLRTLRHLSLAHNNIHSQVSQQLCSTSLRALDFSGNALGHMWAEGDLYLHFFQGLSGLIWLDLSQNRLHTLLPQTLRNLPKSLQVLRLRDNYLAFFKWWSLHFLPKLEVLDLAGNQLKALTNGSLPAGTRLRRLDVSCNSISFVAPGFFSKAKELRELNLSANALKTVDHSWFGPLASALQILDVSANPLHCACGAAFMDFLLEVQAAVPGLPSRVKCGSPGQLQGLSIFAQDLRLCLDEALSWDCFALSLLAVALGLGVPMLHHLCGWDLWYCFHLCLAWLPWRGRQSGRDEDALPYDAFVVFDKTQSAVADWVYNELRGQLEECRGRWALRLCLEERDWLPGKTLFENLWASVYGSRKTLFVLAHTDRVSGLLRASFLLAQQRLLEDRKDVVVLVILSPDGRRSRYVRLRQRLCRQSVLLWPHQPSGQRSFWAQLGMALTRDNHHFYNRNFCQGPTAE

SEQ ID NO: 9838 - RNA, 3099 nt, Artificial Sequence
  TLR9__Homo_sapiens__AAF72189
auggguuucugccgcagcgcccugcacccgcugucucuccuggugcaggccaucaugcuggccaugacccuggcccuggguaccuugccugccuuccuacccugugagcuccagccccacggccuggugaacugcaacuggcuguuccugaagucugugccccacuucuccauggcagcaccccguggcaaugucaccagccuuuccuuguccuccaaccgcauccaccaccuccaugauucugacuuugcccaccugcccagccugcggcaucucaaccucaaguggaacugcccgccgguuggccucagccccaugcacuuccccugccacaugaccaucgagcccagcaccuucuuggcugugcccacccuggaagagcuaaaccugagcuacaacaacaucaugacugugccugcgcugcccaaaucccucauaucccugucccucagccauaccaacauccugaugcuagacucugccagccucgccggccugcaugcccugcgcuuccuauucauggacggcaacuguuauuacaagaaccccugcaggcaggcacuggagguggccccgggugcccuccuuggccugggcaaccucacccaccugucacucaaguacaacaaccucacuguggugccccgcaaccugccuuccagccuggaguaucugcuguuguccuacaaccgcaucgucaaacuggcgccugaggaccuggccaaucugaccgcccugcgugugcucgaugugggcggaaauugccgccgcugcgaccacgcucccaaccccugcauggagugcccucgucacuucccccagcuacaucccgauaccuucagccaccugagccgucuugaaggccugguguugaaggacaguucucucuccuggcugaaugccaguugguuccgugggcugggaaaccuccgagugcuggaccugagugagaacuuccucuacaaaugcaucacuaaaaccaaggccuuccagggccuaacacagcugcgcaagcuuaaccuguccuucaauuaccaaaagaggguguccuuugcccaccugucucuggccccuuccuucgggagccuggucgcccugaaggagcuggacaugcacggcaucuucuuccgcucacucgaugagaccacgcuccggccacuggcccgccugcccaugcuccagacucugcgucugcagaugaacuucaucaaccaggcccagcucggcaucuucagggccuucccuggccugcgcuacguggaccugucggacaaccgcaucagcggagcuucggagcugacagccaccaugggggaggcagauggaggggagaaggucuggcugcagccuggggaccuugcuccggccccaguggacacucccagcucugaagacuucaggcccaacugcagcacccucaacuucaccuuggaucugucacggaacaaccuggugaccgugcagccggagauguuugcccagcucucgcaccugcagugccugcgccugagccacaacugcaucucgcaggcagucaauggcucccaguuccugccgcugaccggucugcaggugcuagaccugucccacaauaagcuggaccucuaccacgagcacucauucacggagcuaccacgacuggaggcccuggaccucagcuacaacagccagcccuuuggcaugcagggcgugggccacaacuucagcuucguggcucaccugcgcacccugcgccaccucagccuggcccacaacaacauccacagccaagugucccagcagcucugcaguacgucgcugcgggcccuggacuucagcggcaaugcacugggccauaugugggccgagggagaccucuaucugcacuucuuccaaggccugagcgguuugaucuggcuggacuugucccagaaccgccugcacacccuccugccccaaacccugcgcaaccuccccaagagccuacaggugcugcgucuccgugacaauuaccuggccuucuuuaagugguggagccuccacuuccugcccaaacuggaaguccucgaccuggcaggaaaccagcugaaggcccugaccaauggcagccugccugcuggcacccggcuccggaggcuggaugucagcugcaacagcaucagcuucguggcccccggcuucuuuuccaaggccaaggagcugcgagagcucaaccuuagcgccaacgcccucaagacaguggaccacuccugguuugggccccuggcgagugcccugcaaauacuagauguaagcgccaacccucugcacugcgccuguggggcggccuuuauggacuuccugcuggaggugcaggcugccgugcccggucugcccagccgggugaaguguggcaguccgggccagcuccagggccucagcaucuuugcacaggaccugcgccucugccuggaugaggcccucuccugggacuguuucgcccucucgcugcuggcuguggcucugggccugggugugcccaugcugcaucaccucuguggcugggaccucugguacugcuuccaccugugccuggccuggcuucccuggcgggggcggcaaagugggcgagaugaggaugcccugcccuacgaugccuucguggucuucgacaaaacgcagagcgcaguggcagacuggguguacaacgagcuucgggggcagcuggaggagugccgugggcgcugggcacuccgccugugccuggaggaacgcgacuggcugccuggcaaaacccucuuugagaaccugugggccucggucuauggcagccgcaagacgcuguuugugcuggcccacacggaccgggucaguggucucuugcgcgccagcuuccugcuggcccagcagcgccugcuggaggaccgcaaggacgucguggugcuggugauccugagcccugacggccgccgcucccgcuacgugcggcugcgccagcgccucugccgccagaguguccuccucuggccccaccagcccaguggucagcgcagcuucugggcccagcugggcauggcccugaccagggacaaccaccacuucuauaaccggaacuucugccagggacccacggccgaauag

SEQ ID NO: 9839 - RNA, 3099 nt, Artificial Sequence
  derived and/or modified sequence opt1 from TLR9__Homo_sapiens__AAF72189
augggcuucugccgcagcgcccugcacccccucucccugcuggugcaggccaucaugcucgcgaugacccuggcccuggggacccucccggccuuccugcccugcgagcugcagccccacggccucgucaacugcaacuggcuguuccugaaguccgugccccacuucagcauggccgccccgcgggggaacgugacgagccucucccugagcuccaaccgcauccaccaccuccacgacagcgacuucgcgcaccuccccucccugcggcaccugaaccucaaguggaacugcccgcccgucggccugagccccaugcacuuccccugccacaugaccaucgagcccuccaccuuccuggccgugcccacccucgaggagcugaaccugagcuacaacaacaucaugacggugccggcccuccccaagucccugaucagccugucccucagccacaccaacauccugaugcuggacuccgccagccucgcggggcugcacgcccugcgcuuccucuucauggacggcaacugcuacuacaagaaccccugccggcaggcccuggaggucgcccccggcgcccugcucgggcugggcaaccugacccaccucucccugaaguacaacaaccugaccguggugccgcgcaaccuccccagcagccuggaguaccugcuccuguccuacaaccggaucgucaagcuggcgcccgaggaccucgccaaccugacggcccugcgcgugcuggacgucgggggcaacugccggcgcugcgaccacgcccccaacccgugcauggagugcccccggcacuucccccagcuccaccccgacaccuucagccaccugucccgccuggaggggcucgugcugaaggacagcucccugagcuggcucaacgccuccugguuccggggccugggcaaccugcgcgugcucgaccugagcgagaacuuccuguacaagugcaucaccaagaccaaggcguuccaggggcucacgcagcugcggaagcugaaccucuccuucaacuaccagaagcgcgugagcuucgcccaccugucccuggccccgagcuucggcucccucgucgcccugaaggagcuggacaugcacgggaucuucuuccggagccucgacgagaccacccugcgcccccuggcccggcuccccaugcugcagacccugcgccuccagaugaacuucaucaaccaggcgcagcugggcaucuuccgggccuuccccggccugcgcuacguggaccucuccgacaaccgcaucagcggggccuccgagcugacggccaccaugggcgaggccgacgggggcgagaagguguggcugcagccgggggaccucgcgcccgcccccgucgacaccccgagcuccgaggacuuccggcccaacugcagcacccugaacuucacgcuggaccucagccgcaacaaccuggugaccgugcagcccgagauguucgcccagcugucccaccuccagugccugcggcugagccacaacugcaucucccaggccgucaacggcagccaguuccucccccugaccggccuccaggugcuggaccugucccacaacaagcuggaccucuaccacgagcacagcuucaccgagcugccgcgccuggaggcgcucgaccuguccuacaacagccagcccuucgggaugcagggcguggggcacaacuucuccuucgucgcccaccuccggacgcugcgccaccugagccuggcccacaacaacauccacucccaggugagccagcagcucugcuccaccagccugcgggcccuggacuucuccggcaacgcccucgggcacaugugggcggagggcgaccuguaccugcacuucuuccagggccucagcgggcugaucuggcuggaccucucccagaaccgccugcacacccugcucccccagacccugcggaaccugcccaagagccuccagguccugcgccugcgggacaacuaccucgccuucuucaagugguggagccugcacuuccugccgaagcucgaggugcuggaccuggccggcaaccagcucaaggcccugacgaacgggucccugcccgccggcacccgccuccggcgccuggacgugagcugcaacuccaucagcuucgucgcgcccggguucuucuccaaggccaaggagcugcgggagcucaaccugagcgccaacgcccugaagaccguggaccacuccugguucggcccccucgccagcgcgcugcagauccuggacguguccgccaacccgcuccacugcgccugcggcgccgcguucauggacuuccugcuggagguccaggccgccgugcccgggcugcccagccgcgugaagugcggcucccccgggcagcuccagggccugagcaucuucgcccaggaccugcggcucugccuggacgaggcccuguccugggacugcuucgcgcucagccugcuggccgucgcccucggccugggggugccgaugcugcaccaccucugcggcugggaccugugguacugcuuccaccugugccucgccuggcugcccuggcgcgggcggcaguccggccgcgacgaggacgcccugcccuacgacgcguucguggucuucgacaagacccagagcgccguggccgacuggguguacaacgagcuccgcgggcagcuggaggagugccggggccgcugggcccugcggcucugccuggaggagcgcgacuggcugcccggcaagacgcuguucgagaaccugugggccuccgucuacgggagccggaagacccuguucgugcucgcgcacaccgaccgcguguccggccugcugcgggccagcuuccuccuggcccagcagcgccugcucgaggaccggaaggacgucguggugcuggucauccugagcccggacgggcgccggucccgcuacgugcggcuccgccagcggcugugccgccagagcgugcugcucuggccccaccagcccuccggccagcggagcuucugggcccagcuggggauggcgcugacccgcgacaaccaccacuucuacaaccggaacuucugccagggccccacggccgaguga

SEQ ID NO: 9840 - RNA, 3099 nt, Artificial Sequence
  derived and/or modified sequence opt2 from TLR9__Homo_sapiens__AAF72189
augggcuucugccgcuccgcccuccacccccucucccuccucguccaggccaucaugcucgccaugacccucgcccucggcacccuccccgccuuccuccccugcgagcuccagccccacggccucgucaacugcaacuggcucuuccucaaguccgucccccacuucuccauggccgccccccgcggcaacgucaccucccucucccucuccuccaaccgcauccaccaccuccacgacuccgacuucgcccaccuccccucccuccgccaccucaaccucaaguggaacugcccccccgucggccucucccccaugcacuuccccugccacaugaccaucgagcccuccaccuuccucgccguccccacccucgaggagcucaaccucuccuacaacaacaucaugaccguccccgcccuccccaagucccucaucucccucucccucucccacaccaacauccucaugcucgacuccgccucccucgccggccuccacgcccuccgcuuccucuucauggacggcaacugcuacuacaagaaccccugccgccaggcccucgaggucgcccccggcgcccuccucggccucggcaaccucacccaccucucccucaaguacaacaaccucaccgucgucccccgcaaccuccccuccucccucgaguaccuccuccucuccuacaaccgcaucgucaagcucgcccccgaggaccucgccaaccucaccgcccuccgcguccucgacgucggcggcaacugccgccgcugcgaccacgcccccaaccccugcauggagugcccccgccacuucccccagcuccaccccgacaccuucucccaccucucccgccucgagggccucguccucaaggacuccucccucuccuggcucaacgccuccugguuccgcggccucggcaaccuccgcguccucgaccucuccgagaacuuccucuacaagugcaucaccaagaccaaggccuuccagggccucacccagcuccgcaagcucaaccucuccuucaacuaccagaagcgcgucuccuucgcccaccucucccucgcccccuccuucggcucccucgucgcccucaaggagcucgacaugcacggcaucuucuuccgcucccucgacgagaccacccuccgcccccucgcccgccuccccaugcuccagacccuccgccuccagaugaacuucaucaaccaggcccagcucggcaucuuccgcgccuuccccggccuccgcuacgucgaccucuccgacaaccgcaucuccggcgccuccgagcucaccgccaccaugggcgaggccgacggcggcgagaaggucuggcuccagcccggcgaccucgcccccgcccccgucgacacccccuccuccgaggacuuccgccccaacugcuccacccucaacuucacccucgaccucucccgcaacaaccucgucaccguccagcccgagauguucgcccagcucucccaccuccagugccuccgccucucccacaacugcaucucccaggccgucaacggcucccaguuccucccccucaccggccuccagguccucgaccucucccacaacaagcucgaccucuaccacgagcacuccuucaccgagcucccccgccucgaggcccucgaccucuccuacaacucccagcccuucggcaugcagggcgucggccacaacuucuccuucgucgcccaccuccgcacccuccgccaccucucccucgcccacaacaacauccacucccaggucucccagcagcucugcuccaccucccuccgcgcccucgacuucuccggcaacgcccucggccacaugugggccgagggcgaccucuaccuccacuucuuccagggccucuccggccucaucuggcucgaccucucccagaaccgccuccacacccuccucccccagacccuccgcaaccuccccaagucccuccagguccuccgccuccgcgacaacuaccucgccuucuucaagugguggucccuccacuuccuccccaagcucgagguccucgaccucgccggcaaccagcucaaggcccucaccaacggcucccuccccgccggcacccgccuccgccgccucgacgucuccugcaacuccaucuccuucgucgcccccggcuucuucuccaaggccaaggagcuccgcgagcucaaccucuccgccaacgcccucaagaccgucgaccacuccugguucggcccccucgccuccgcccuccagauccucgacgucuccgccaacccccuccacugcgccugcggcgccgccuucauggacuuccuccucgagguccaggccgccguccccggccuccccucccgcgucaagugcggcucccccggccagcuccagggccucuccaucuucgcccaggaccuccgccucugccucgacgaggcccucuccugggacugcuucgcccucucccuccucgccgucgcccucggccucggcguccccaugcuccaccaccucugcggcugggaccucugguacugcuuccaccucugccucgccuggcuccccuggcgcggccgccaguccggccgcgacgaggacgcccuccccuacgacgccuucgucgucuucgacaagacccaguccgccgucgccgacugggucuacaacgagcuccgcggccagcucgaggagugccgcggccgcugggcccuccgccucugccucgaggagcgcgacuggcuccccggcaagacccucuucgagaaccucugggccuccgucuacggcucccgcaagacccucuucguccucgcccacaccgaccgcgucuccggccuccuccgcgccuccuuccuccucgcccagcagcgccuccucgaggaccgcaaggacgucgucguccucgucauccucucccccgacggccgccgcucccgcuacguccgccuccgccagcgccucugccgccaguccguccuccucuggccccaccagcccuccggccagcgcuccuucugggcccagcucggcauggcccucacccgcgacaaccaccacuucuacaaccgcaacuucugccagggccccaccgccgaguga

SEQ ID NO: 9841 - RNA, 3099 nt, Artificial Sequence
  derived and/or modified sequence opt3 from TLR9__Homo_sapiens__AAF72189
augggcuucugcagaagcgcccugcacccccucucccuucuggugcaggcuaucauguuggcaaugaccuuagcccuggggacacuaccugcguuucucccaugugagcugcaaccgcauggacuugucaacugcaauuggcuguucuugaagucuguuccccacuuuucaauggcugccccuagggguaacgugacgagucucagccuguccucuaaucggauucaucaccuucaugacucggauuucgcacaccucccaucauuacgccaccugaaccuuaaauggaauugucccccuguaggcuugagcccaaugcauuuucccugccacaugacuauagaaccuaguaccuuccuggccgugccaacacuagaggaacucaaccuguccuacaauaacaucaugacugucccggcucugcccaagucucugauuagcuugucccucucacauaccaauauccugauguuagacagugcaagccuggccgggcuccacgcucugcgauuucuguucauggauggaaacuguuauuacaaaaauccuugccgucaggccuuggagguggcgccaggcgcacuacugggucucgggaaccugacacaccuuucucugaaguauaauaacuugaccguugugcccagaaaucucccuuccucacuggaauacuuacugcuaagcuauaacaggauugucaaacucgccccagaggaccuggcuaaccuuacugccuugcgggugcuggauguaggaggcaauugucgcagaugcgaccaugcacccaacccguguauggagugcccuaggcacuuuccccagcuccauccagauacauucagucaccugucucggcuugaaggccugguuuugaaggacuccagccucucguggcugaaugcuucuugguuucgcggguuaggaaaccugcgagugcuagaucucuccgagaauuuccuguacaaguguaucaccaaaacgaaggccuuucagggucuuacucaauugagaaaacugaaccucucauucaauuaucagaagagggucaguuucgcgcaucugagcuuagccccuuccuuuggcucucugguggcacuuaaagaauuggacaugcacgggauauucuuucggagccucgaugagaccacacugcguccccuagcucgccugccaaugcuccagacucugagacuucagaugaacuucaucaaucaagcccaguugggaauuuuuagggcuuuccccggccugcgguacguggacuuaucagauaaccgaaucaguggugccuccgagcucaccgcaacaaugggggaagccgacggaggcgagaaggucuggcugcagccuggcgaccuugcuccagcgccgguugauacccccagcucugaagacuuucgcccuaauugcucaacgcugaacuucacuuuggaucucaguagaaauaaccuggugacaguacagccagagauguuugcacaacuaagccaccuucagugccucaggcugucccauaauuguauuucucaggccgugaacgggucgcaauuccuucccuugaccggacugcaggucuuagaccucagccacaacaagcuggaucuuuaccaugaacacuccuuuacugagcugccucggcuagaggcucucgaccugucauauaauagucagccauucgguaugcagggcguggggcacaacuuuucuuucguugcccauuugcgcacacugagacacuuaagccucgcacauaauaacauccacucccaagugucacagcagcugugcagcaccucucuuagggcccuggauuucuccggaaaugcuuugggccauaugugggccgaaggugaccucuaccugcacuuuuuccaggggcuaaguggccugauauggcuugaucucagccaaaaccgucugcacacguugcugccccagaccuuacggaaucucccgaaaucucugcagguccuucgacugagagacaacuauuuggcauuuuucaagugguggucccuccauuuucugccuaaacuagaggugcuggaucuugcgggaaaucagcucaaggcucugacaaacggcucauugccagccgggacuagguuacgccggcuggacguaaguuguaauagcauuucguucguugcacccggauuuuucuccaaagccaaggaacucagagagcugaaccuuucugcuaaugcccugaaaaccguggaccacagcugguuugguccuuuggcaucagcucuacaaauccuggaugucagugccaacccccuccauugcgcguguggcgccgcuuucauggacuuucugcuugaagugcaggcagccgucccaggguuaccuuccagggugaagugcggaucucccggccagcugcagggucucagcauuuucgcucaagauuugcgccugugucucgacgaggcccuguccugggauugcuuugcacuuucacuguuggcgguugcccuagggcugggcgugccaaugcuccaccauuuauguggaugggaccugugguacugcuuccaccuuugucuggcuuggcucccguggcgaggccggcagagcgggcgugaugaggacgccuugccuuaugaugcauucguagucuuugacaagacacagagugcuguggccgauuggguuuacaaugaacugagaggacaacucgaggaaugcaggggucgcugggcacugcggcuuugccuagaggaaagagacuggcugcccggcaaaacuuuguucgagaacuuaugggccucuguguauggguccaggaagacccuguuuguccucgcucacacagaucgagugagcggacugcuucgcgcgucguuccugcucgcccagcagcgguugcuggaggacagaaaagacguagugguucuagucauccugucaccagauggcaggcguucucgcuacgugcggcucagacagaggcuuugucgacaaagugugcuguuauggccccaucagccuuccggucagcggagcuuuugggcacaguuggggauggcucugacccgcgacaaccaccauuucuacaauagaaacuuuugccaaggcccaacugccgaauga

SEQ ID NO: 9842 - RNA, 3099 nt, Artificial Sequence
  derived and/or modified sequence opt4 from TLR9__Homo_sapiens__AAF72189
augggcuucugcagaagcgcccugcacccccugagccugcuggugcaggccaucaugcuggccaugacccuggcccugggcacccugcccgccuuccugcccugcgagcugcagccccacggccuggugaacugcaacuggcuguuccugaagagcgugccccacuucagcauggccgcccccagaggcaacgugaccagccugagccugagcagcaacagaauccaccaccugcacgacagcgacuucgcccaccugcccagccugagacaccugaaccugaaguggaacugcccccccgugggccugagccccaugcacuuccccugccacaugaccaucgagcccagcaccuuccuggccgugcccacccuggaggagcugaaccugagcuacaacaacaucaugaccgugcccgcccugcccaagagccugaucagccugagccugagccacaccaacauccugaugcuggacagcgccagccuggccggccugcacgcccugagauuccuguucauggacggcaacugcuacuacaagaaccccugcagacaggcccuggagguggcccccggcgcccugcugggccugggcaaccugacccaccugagccugaaguacaacaaccugaccguggugcccagaaaccugcccagcagccuggaguaccugcugcugagcuacaacagaaucgugaagcuggcccccgaggaccuggccaaccugaccgcccugagagugcuggacgugggcggcaacugcagaagaugcgaccacgcccccaaccccugcauggagugccccagacacuucccccagcugcaccccgacaccuucagccaccugagcagacuggagggccuggugcugaaggacagcagccugagcuggcugaacgccagcugguucagaggccugggcaaccugagagugcuggaccugagcgagaacuuccuguacaagugcaucaccaagaccaaggccuuccagggccugacccagcugagaaagcugaaccugagcuucaacuaccagaagagagugagcuucgcccaccugagccuggcccccagcuucggcagccugguggcccugaaggagcuggacaugcacggcaucuucuucagaagccuggacgagaccacccugagaccccuggccagacugcccaugcugcagacccugagacugcagaugaacuucaucaaccaggcccagcugggcaucuucagagccuuccccggccugagauacguggaccugagcgacaacagaaucagcggcgccagcgagcugaccgccaccaugggcgaggccgacggcggcgagaagguguggcugcagcccggcgaccuggcccccgcccccguggacacccccagcagcgaggacuucagacccaacugcagcacccugaacuucacccuggaccugagcagaaacaaccuggugaccgugcagcccgagauguucgcccagcugagccaccugcagugccugagacugagccacaacugcaucagccaggccgugaacggcagccaguuccugccccugaccggccugcaggugcuggaccugagccacaacaagcuggaccuguaccacgagcacagcuucaccgagcugcccagacuggaggcccuggaccugagcuacaacagccagcccuucggcaugcagggcgugggccacaacuucagcuucguggcccaccugagaacccugagacaccugagccuggcccacaacaacauccacagccaggugagccagcagcugugcagcaccagccugagagcccuggacuucagcggcaacgcccugggccacaugugggccgagggcgaccuguaccugcacuucuuccagggccugagcggccugaucuggcuggaccugagccagaacagacugcacacccugcugccccagacccugagaaaccugcccaagagccugcaggugcugagacugagagacaacuaccuggccuucuucaagugguggagccugcacuuccugcccaagcuggaggugcuggaccuggccggcaaccagcugaaggcccugaccaacggcagccugcccgccggcaccagacugagaagacuggacgugagcugcaacagcaucagcuucguggcccccggcuucuucagcaaggccaaggagcugagagagcugaaccugagcgccaacgcccugaagaccguggaccacagcugguucggcccccuggccagcgcccugcagauccuggacgugagcgccaacccccugcacugcgccugcggcgccgccuucauggacuuccugcuggaggugcaggccgccgugcccggccugcccagcagagugaagugcggcagccccggccagcugcagggccugagcaucuucgcccaggaccugagacugugccuggacgaggcccugagcugggacugcuucgcccugagccugcuggccguggcccugggccugggcgugcccaugcugcaccaccugugcggcugggaccugugguacugcuuccaccugugccuggccuggcugcccuggagaggcagacagagcggcagagacgaggacgcccugcccuacgacgccuucgugguguucgacaagacccagagcgccguggccgacuggguguacaacgagcugagaggccagcuggaggagugcagaggcagaugggcccugagacugugccuggaggagagagacuggcugcccggcaagacccuguucgagaaccugugggccagcguguacggcagcagaaagacccuguucgugcuggcccacaccgacagagugagcggccugcugagagccagcuuccugcuggcccagcagagacugcuggaggacagaaaggacgugguggugcuggugauccugagccccgacggcagaagaagcagauacgugagacugagacagagacugugcagacagagcgugcugcuguggccccaccagcccagcggccagagaagcuucugggcccagcugggcauggcccugaccagagacaaccaccacuucuacaacagaaacuucugccagggccccaccgccgaguga

SEQ ID NO: 9843 - RNA, 3099 nt, Artificial Sequence
  derived and/or modified sequence opt5 from TLR9__Homo_sapiens__AAF72189
augggcuucugcagaagcgcccugcacccccucucccugcuugugcaggcuaucaugcuggccaugacccucgcgcuggggacacuuccugcuuuucugccgugugagcuccaaccccauggacuggucaacugcaauuggcuguuccucaagucuguuccucacuuuagcauggccgcuccccggggcaacgugacgucccugucucuuagcuccaaucgcauucaucaucugcacgacucugauuucgcucaccucccuagccugagacaccuuaaccugaaauggaauugucccccuguggggcucuccccgaugcauuuucccugccacaugaccaucgaaccuagcacauuccuggccguccccacccuggaggaacucaaccugucuuacaauaacauuaugacagugccugcucugcccaagucccugaucagccucucucugucccauaccaauauucuuaugcuggacagcgccucucucgcgggacugcacgcccugcgguuucucuucauggauggcaacuguuauuacaaaaauccgugccgccaggcucuggagguugccccuggggcccuucugggacucggcaaccugacacaccuuucccugaaguauaauaaccucaccgugguccccagaaaucugccuagcucccuggaauaccuccugcuuucuuauaaccggaucgugaaacuggcccccgaggaccucgcgaaccugacggcccugcgcguucuugaugugggcgggaauuguagacggugcgaccaugcucccaacccuuguauggagugcccgcgccacuuuccccagcuccauccugauaccuucagccaccuguccagacuggaaggacucguccugaaggacagcucucuuuccuggcugaaugccagcugguuucggggccucgggaaccugcgcgugcuggaucuuucugagaauuuccucuacaaguguaucacaaaaaccaaggcuuuucagggacugacacaacugagaaaacucaaccugagcuucaauuaucagaagcggguguccuucgcccaucuuucucuggcccccagcuuuggcucccucgucgcucugaaagaacuggacaugcacgggauuuucuuucgcagccuugaugagaccacgcucagaccucuggcgcggcugcccaugcuccagacacugagacuucagaugaacuucaucaaucaagcccagcugggaauuuuucgcgcuuucccgggccuccgguacguugaccugucugauaacagaaucuccggcgccagcgagcugaccgccacaaugggggaagcugacggaggcgagaagguguggcuucagccuggggaccucgcccccgcgccuguggauacccccucuuccgaagacuuucgcccuaauugcagcacccugaacuucacacuggaucucucccggaauaaccuggucacggugcagcccgagauguuugcucaacuuucucaucugcagugccucagacugagccacaauuguauuucccaggccguuaacggaucucaauuccugccgcuuaccggccuucaggugcucgaccugagccacaacaagcucgaucuguaccaugaacacuccuuuacagagcuuccucgccuggaggcccucgaccugagcuauaauucucagcccuucgggaugcagggagucggccacaacuuuuccuucguggcucaucugcggacccuuagacaccugagccucgcccauaauaacauccacucucaaguuucccagcagcugugcagcacaucucuccgcgcucuggauuucagcggcaaugcccuugggcauaugugggcggaaggagaccuguaccuccacuuuuuccagggccuguccgggcugauuuggcuugaucugagccaaaaccggcuccacacccugcucccccagacgcugagaaaucuuccuaaaucucuccaggugcugcgccugcgggacaacuaucuggccuuuuucaagugguggucccuucauuuucugccgaaacucgagguccuggaucucgcuggaaaucagcugaaggcccuuacaaacggcagccugcccgcugggaccagacugcggcgccucgacguguccuguaauucuaucagcuucgucgccccuggcuuuuucuccaaagcgaaggaacugagagagcuuaaccugucugccaaugcucucaaaaccguggaccacagcugguuuggaccccuggccuccgcucuccaaauccuggauguuucugccaacccucuucauugcgccuguggcgcugcguucauggacuuucugcuggaagugcaggccgcuguccccgggcucccuagccgggugaagugcggaucccccggccagcugcaggggcuuagcauuuucgcccaagaucugagacucugucuggacgaggcccucucuugggauugcuuugcucugucccuucuggccguugcgcugggacucggcgugccgaugcugcaccaucuuugugggugggaccugugguacugcuuccaccucugucuggcuuggcugccuuggcgcggccggcagagcggaagagaugaggacgcccuccccuaugaugccuucgucguguuugacaagacacagucugcuguggccgauuggguuuacaaugaacuucgcggccaacuggaggaaugcagagggcggugggcgcugcgccucugccuggaggaaagagacuggcuuccuggaaaaacccuguucgagaaccucugggcuuccgucuauggcagccggaagacacuguuugugcuggcccacacggaucgcgugucugggcuccuuagagccuccuuccugcuggcucagcagcggcuccuggaggaccgcaaagacgucgugguucuugugauccugagccccgauggaagacggucccgcuacgucagacuccggcagagacugugucgccaaagcgugcugcucuggccgcaucagccuucuggccagcggagcuuuugggcccagcuugggauggcucugaccagagacaaccaccauuucuacaaucgcaacuuuugccaaggccccacagccgaauga

SEQ ID NO: 9844 - protein, 522 aa, Artificial Sequence
  TRAF6__Homo_sapiens__Q9Y4K3
MSLLNCENSCGSSQSESDCCVAMASSCSAVTKDDSVGGTASTGNLSSSFMEEIQGYDVEFDPPLESKYECPICLMALREAVQTPCGHRFCKACIIKSIRDAGHKCPVDNEILLENQLFPDNFAKREILSLMVKCPNEGCLHKMELRHLEDHQAHCEFALMDCPQCQRPFQKFHINIHILKDCPRRQVSCDNCAASMAFEDKEIHDQNCPLANVICEYCNTILIREQMPNHYDLDCPTAPIPCTFSTFGCHEKMQRNHLARHLQENTQSHMRMLAQAVHSLSVIPDSGYISEVRNFQETIHQLEGRLVRQDHQIRELTAKMETQSMYVSELKRTIRTLEDKVAEIEAQQCNGIYIWKIGNFGMHLKCQEEEKPVVIHSPGFYTGKPGYKLCMRLHLQLPTAQRCANYISLFVHTMQGEYDSHLPWPFQGTIRLTILDQSEAPVRQNHEEIMDAKPELLAFQRPTIPRNPKGFGYVTFMHLEALRQRTFIKDDTLLVRCEVSTRFDMGSLRREGFQPRSTDAGV

SEQ ID NO: 9845 - RNA, 1569 nt, Artificial Sequence
  TRAF6__Homo_sapiens__AAB38751
augagucugcuaaacugugaaaacagcuguggauccagccagucugaaagugacugcuguguggccauggccagcuccuguagcgcuguaacaaaagaugauaguguggguggaacugccagcacggggaaccucuccagcucauuuauggaggagauccagggauaugauguagaguuugacccaccccuggaaagcaaguaugaaugccccaucugcuugauggcauuacgagaagcagugcaaacgccaugcggccauagguucugcaaagccugcaucauaaaaucaauaagggaugcaggucacaaauguccaguugacaaugaaauacugcuggaaaaucaacuauuuccagacaauuuugcaaaacgugagauucuuucucugauggugaaauguccaaaugaagguuguuugcacaagauggaacugagacaucuugaggaucaucaagcacauugugaguuugcucuuauggauuguccccaaugccagcgucccuuccaaaaauuccauauuaauauucacauucugaaggauuguccaaggagacagguuucuugugacaacugugcugcaucaauggcauuugaagauaaagagauccaugaccagaacuguccuuuggcaaaugucaucugugaauacugcaauacuauacucaucagagaacagaugccuaaucauuaugaucuagacugcccuacagccccaauuccaugcacauucaguacuuuugguugccaugaaaagaugcagaggaaucacuuggcacgccaccuacaagagaacacccagucacacaugagaauguuggcccaggcuguucauaguuugagcguuauacccgacucuggguauaucucagagguccggaauuuccaggaaacuauucaccaguuagagggucgccuuguaagacaagaccaucaaauccgggagcugacugcuaaaauggaaacucagaguauguauguaagugagcucaaacgaaccauucgaacccuugaggacaaaguugcugaaaucgaagcacagcagugcaauggaauuuauauuuggaagauuggcaacuuuggaaugcauuugaaaugucaagaagaggagaaaccuguugugauucauagcccuggauucuacacuggcaaacccggguacaaacugugcaugcgcuugcaccuucaguuaccgacugcucagcgcugugcaaacuauauaucccuuuuuguccacacaaugcaaggagaauaugacagccaccucccuuggcccuuccaggguacaauacgccuuacaauucuugaucagucugaagcaccuguaaggcaaaaccacgaagagauaauggaugccaaaccagagcugcuugcuuuccagcgacccacaaucccacggaacccaaaagguuuuggcuauguaacuuuuaugcaucuggaagcccuaagacaaagaacuuucauuaaggaugacacauuauuagugcgcugugaggucuccacccgcuuugacauggguagccuucggagggaggguuuucagccacgaaguacugaugcagggguauag

SEQ ID NO: 9846 - RNA, 1569 nt, Artificial Sequence
  derived and/or modified sequence opt1 from TRAF6__Homo_sapiens__AAB38751
augagccugcucaacugcgagaacuccugcggcagcucccagagcgaguccgacugcugcguggccauggccagcuccugcagcgcggucaccaaggacgacuccgucgggggcaccgccagcacggggaaccuguccagcuccuucauggaggagauccagggcuacgacguggaguucgacccgccccuggagagcaaguacgagugccccaucugccucauggcccugcgcgaggccgugcagacccccugcgggcaccgguucugcaaggccugcaucaucaaguccauccgcgacgcgggccacaagugccccguggacaacgagauccugcucgagaaccagcuguucccggacaacuucgccaagcgggagauccugagccucauggugaagugccccaacgagggcugccugcacaagauggagcugcgccaccucgaggaccaccaggcccacugcgaguucgcccugauggacugcccccagugccagcggcccuuccagaaguuccacaucaacauccacauccugaaggacugcccgcgccggcaggucuccugcgacaacugcgcggccagcauggccuucgaggacaaggagauccacgaccagaacugcccccucgccaacgugaucugcgaguacugcaacaccauccugauccgcgagcagaugcccaaccacuacgaccuggacugccccaccgccccgauccccugcacguucuccaccuucgggugccacgagaagaugcagcggaaccaccucgcgcgccaccuccaggagaacacccagagccacaugcggaugcuggcccaggccgugcacagccuguccgucauccccgacagcggcuacaucuccgaggugcgcaacuuccaggagaccauccaccagcuggaggggcggcuggugcgccaggaccaccagauccgggagcucacggccaagauggagacccagagcauguacgucuccgagcugaagcgcaccauccggacccuggaggacaagguggccgagaucgaggcgcagcagugcaacggcaucuacaucuggaagaucgggaacuucggcaugcaccucaagugccaggaggaggagaagcccguggucauccacagcccgggcuucuacacggggaagcccggcuacaagcugugcaugcgccugcaccuccagcugcccaccgcccagcggugcgccaacuacaucucccuguucgugcacaccaugcagggggaguacgacagccaccuccccuggccguuccagggcaccauccgccugacgauccuggaccaguccgaggcccccgugcggcagaaccacgaggagaucauggacgccaagcccgagcuccuggcguuccagcgccccaccaucccgcgcaaccccaagggcuucggguacgucaccuucaugcaccuggaggcccuccggcagcgcaccuucaucaaggacgacacgcugcuggugcggugcgaggugagcacccgcuucgacaugggcucccuccggcgcgagggguuccagccccggagcaccgacgccggcgucuga

SEQ ID NO: 9847 - RNA, 1569 nt, Artificial Sequence
  derived and/or modified sequence opt2 from TRAF6__Homo_sapiens__AAB38751
augucccuccucaacugcgagaacuccugcggcuccucccaguccgaguccgacugcugcgucgccauggccuccuccugcuccgccgucaccaaggacgacuccgucggcggcaccgccuccaccggcaaccucuccuccuccuucauggaggagauccagggcuacgacgucgaguucgaccccccccucgaguccaaguacgagugccccaucugccucauggcccuccgcgaggccguccagacccccugcggccaccgcuucugcaaggccugcaucaucaaguccauccgcgacgccggccacaagugccccgucgacaacgagauccuccucgagaaccagcucuuccccgacaacuucgccaagcgcgagauccucucccucauggucaagugccccaacgagggcugccuccacaagauggagcuccgccaccucgaggaccaccaggcccacugcgaguucgcccucauggacugcccccagugccagcgccccuuccagaaguuccacaucaacauccacauccucaaggacugcccccgccgccaggucuccugcgacaacugcgccgccuccauggccuucgaggacaaggagauccacgaccagaacugcccccucgccaacgucaucugcgaguacugcaacaccauccucauccgcgagcagaugcccaaccacuacgaccucgacugccccaccgcccccauccccugcaccuucuccaccuucggcugccacgagaagaugcagcgcaaccaccucgcccgccaccuccaggagaacacccagucccacaugcgcaugcucgcccaggccguccacucccucuccgucauccccgacuccggcuacaucuccgagguccgcaacuuccaggagaccauccaccagcucgagggccgccucguccgccaggaccaccagauccgcgagcucaccgccaagauggagacccaguccauguacgucuccgagcucaagcgcaccauccgcacccucgaggacaaggucgccgagaucgaggcccagcagugcaacggcaucuacaucuggaagaucggcaacuucggcaugcaccucaagugccaggaggaggagaagcccgucgucauccacucccccggcuucuacaccggcaagcccggcuacaagcucugcaugcgccuccaccuccagcuccccaccgcccagcgcugcgccaacuacaucucccucuucguccacaccaugcagggcgaguacgacucccaccuccccuggcccuuccagggcaccauccgccucaccauccucgaccaguccgaggcccccguccgccagaaccacgaggagaucauggacgccaagcccgagcuccucgccuuccagcgccccaccaucccccgcaaccccaagggcuucggcuacgucaccuucaugcaccucgaggcccuccgccagcgcaccuucaucaaggacgacacccuccucguccgcugcgaggucuccacccgcuucgacaugggcucccuccgccgcgagggcuuccagccccgcuccaccgacgccggcgucuga

SEQ ID NO: 9848 - RNA, 1569 nt, Artificial Sequence
  derived and/or modified sequence opt3 from TRAF6__Homo_sapiens__AAB38751
augagccugcucaacugcgaaaauuccugugggucuucacagagugagagcgacugcuguguggccauggcuuccucuugcucggcagucaccaaggaugacucaguuggcggaacagccagcacugguaaccuuaguuccucuuucauggaggaaauccaaggcuacgauguggaguuugaucccccucuggaaagcaaauaugaguguccaauuugcuugauggcguuaagagaggcuguacagacgccgugugggcacagguucugcaaggccuguauaaucaaauccauucgggacgcaggacauaagugccccguggacaaugaaauccugcuagagaaccagcucuuuccugauaauuucgccaaacgcgaaauucugucacuuauggucaaguguccaaacgagggcugccugcacaagauggaguugcgacaucucgaagaccaccaggcucauugcgaguuugcacugauggauuguccccaaugccagcguccuuuccagaaauuucacaucaauauacacauccugaaggacuguccaagacgccaggugaguugcgauaacugugccgcuagcauggccuucgaagacaaagagauucaugaucaaaauugcccccucgcgaacguuaucugugaauacugcaauaccauuuuaauccgggagcagaugccuaaccacuaugaccuggacuguccaacagcaccgauacccugcacuuuuucuaccuucgguugucaugagaagaugcagcgcaaucaccuugccagacacuugcaggaaaacacacaaucccauaugaggaugcuggcucaggccgugcacucacuaagcgucauuccugauaguggguacaucucugaggugcggaauuuucaggaaaccauucaucaacucgagggacgccugguacgacaggaccaccagaucagagaacuuacugcaaaaauggagacacaguccauguauguuagcgagcugaagaggaccauccggacguuggaagauaagguggcugagauugaagcccaacagugcaacggcauauacaucuggaaaauuggcaacuucgggaugcaucucaagugccaggaggaagagaaaccagucgugauccacucgcccggauuuuauacugguaagccuggcuacaaacuguguaugcguuuacaucugcagcucccaaccgcgcaacgcugcgccaauuacauaucucuuuucgugcacacaaugcagggggaguaugacucccaucugcccuggccguuccagggaacuauuagauugaccauccuagaucagucagaagcaccugucaggcaaaaccacgaggaaaucauggacgcuaagcccgagcugcucgccuuucagcggccaacaauuccucgaaaucccaaaggcuucgguuacguuaccuuuaugcaccuggaggcucuuaggcagagaacguucaucaaggaugacacucuguuggugaggugugaaguaaguacacgguuugauauggggagccuccgcagagagggauuccagccaagguccaccgacgccggcguguga

SEQ ID NO: 9849 - RNA, 1569 nt, Artificial Sequence
  derived and/or modified sequence opt4 from TRAF6__Homo_sapiens__AAB38751
augagccugcugaacugcgagaacagcugcggcagcagccagagcgagagcgacugcugcguggccauggccagcagcugcagcgccgugaccaaggacgacagcgugggcggcaccgccagcaccggcaaccugagcagcagcuucauggaggagauccagggcuacgacguggaguucgaccccccccuggagagcaaguacgagugccccaucugccugauggcccugagagaggccgugcagacccccugcggccacagauucugcaaggccugcaucaucaagagcaucagagacgccggccacaagugccccguggacaacgagauccugcuggagaaccagcuguuccccgacaacuucgccaagagagagauccugagccugauggugaagugccccaacgagggcugccugcacaagauggagcugagacaccuggaggaccaccaggcccacugcgaguucgcccugauggacugcccccagugccagagacccuuccagaaguuccacaucaacauccacauccugaaggacugccccagaagacaggugagcugcgacaacugcgccgccagcauggccuucgaggacaaggagauccacgaccagaacugcccccuggccaacgugaucugcgaguacugcaacaccauccugaucagagagcagaugcccaaccacuacgaccuggacugccccaccgcccccauccccugcaccuucagcaccuucggcugccacgagaagaugcagagaaaccaccuggccagacaccugcaggagaacacccagagccacaugagaaugcuggcccaggccgugcacagccugagcgugauccccgacagcggcuacaucagcgaggugagaaacuuccaggagaccauccaccagcuggagggcagacuggugagacaggaccaccagaucagagagcugaccgccaagauggagacccagagcauguacgugagcgagcugaagagaaccaucagaacccuggaggacaagguggccgagaucgaggcccagcagugcaacggcaucuacaucuggaagaucggcaacuucggcaugcaccugaagugccaggaggaggagaagcccguggugauccacagccccggcuucuacaccggcaagcccggcuacaagcugugcaugagacugcaccugcagcugcccaccgcccagagaugcgccaacuacaucagccuguucgugcacaccaugcagggcgaguacgacagccaccugcccuggcccuuccagggcaccaucagacugaccauccuggaccagagcgaggcccccgugagacagaaccacgaggagaucauggacgccaagcccgagcugcuggccuuccagagacccaccauccccagaaaccccaagggcuucggcuacgugaccuucaugcaccuggaggcccugagacagagaaccuucaucaaggacgacacccugcuggugagaugcgaggugagcaccagauucgacaugggcagccugagaagagagggcuuccagcccagaagcaccgacgccggcguguga

SEQ ID NO: 9850 - RNA, 1569 nt, Artificial Sequence
  derived and/or modified sequence opt5 from TRAF6__Homo_sapiens__AAB38751
augagccugcucaacugcgagaauagcuguggcucuagccaguccgaaucugacugcuguguggccauggcuagcuccugcucugccgucaccaaggaugacagcguugggggaacagcguccacgggcaaccuguccucuuccuucauggaggaaauccaaggguacgauguggaguuugaucccccucuugaaagcaaauaugaguguccgauuugccugauggcucucagagaggccgugcagacccccuguggacaccgguucugcaaggccuguaucauuaaaucuauccgcgacgcuggccauaagugcccugucgacaaugaaauucugcuugagaaccagcuguuucccgauaauuucgccaaaagagaaauccucucccugauggugaaguguccuaacgaggggugccugcacaagauggagcuccggcaucuggaagaccaccaggcucauugcgaguuugcccuuauggauuguccccaaugccagcgcccuuuccagaaauuucacaucaauauucacauccugaaggacuguccgagacggcagguuagcugcgauaacugugcggccucuauggcuuucgaagacaaagagauucaugaucaaaauugcccccucgccaacgugaucugugaauacugcaauacaauucugauccgcgagcagaugccuaaccacuaugaccuugacugucccaccgcuccuauucccugcacauuuuccaccuucggaugucaugagaagaugcagagaaaucaccuggcccggcaccuccaggaaaacacacaaagccauaugcgcaugcuggcgcaggccguccacucccugucugugaucccggauagcggcuacaucuccgagguuagaaauuuucaggaaaccauucaucaacucgagggccggcuggugcgccaggaccaccagaucagagaacuuacggcuaaaauggagacccagagcauguaugucucugagcugaagcggacaauucgcacccucgaagauaagguggccgagaucgaagcucaacagugcaacgggauuuacaucuggaaaaucggaaacuucggcaugcaucugaagugccaggaggaagagaaaccuguggucauucacucccccggguuuuauacaggaaagccuggcuacaaacuuuguaugagacugcaccuccagcugcccaccgcccaacggugcgccaauuacaucagccuguucguucauacgaugcagggggaguaugacucucaccuccccuggccuuuccagggaacaauuagacugaccauccuugaucagagcgaagcuccggugcgccaaaaccaugaggaaauuauggacgcgaagcccgagcugcucgccuuucagcggccuacaauccccagaaauccuaaaggcuucggcuacgugaccuuuaugcaccuggaggcccuucgccagcggaccuucaucaaggaugacacacugcucgucagaugugaaguguccacgcgcuuugauauggggucucugcggagagagggauuccagccccgcagcaccgacgcuggcguuuga

SEQ ID NO: 9851 - protein, 257 aa, Artificial Sequence
  c-myc__Homo_sapiens__A0A0B4J1R1
MPLNVSFTNRNYDLDYDSVQPYFYCDEEENFYQQQQQSELQPPAPSEDIWKKFELLPTPPLSPSRRSGLCSPSYVAVTPFSLRGDNDGGGGSFSTADQLEMVTELLGGDMVNQSFICDPDDETFIKNIIIQDCMWSGFSAAAKLVSEKLASYQAARKDSGSPNPARGHSVCSTSSLYLQDLSAAASECIDPSVVFPYPLNDSSSPKSCASQDSSAFSPSSDSLLSSTESSPQGSPEPLVLHEETPPTTSSDSGGTRR

SEQ ID NO: 9852 - RNA, 774 nt, Artificial Sequence
  c-myc__Homo_sapiens__EAW92099
augccccucaacguuagcuucaccaacaggaacuaugaccucgacuacgacucggugcagccguauuucuacugcgacgaggaggagaacuucuaccagcagcagcagcagagcgagcugcagcccccggcgcccagcgaggauaucuggaagaaauucgagcugcugcccaccccgccccuguccccuagccgccgcuccgggcucugcucgcccuccuacguugcggucacacccuucucccuucggggagacaacgacggcgguggcgggagcuucuccacggccgaccagcuggagauggugaccgagcugcugggaggagacauggugaaccagaguuucaucugcgacccggacgacgagaccuucaucaaaaacaucaucauccaggacuguauguggagcggcuucucggccgccgccaagcucgucucagagaagcuggccuccuaccaggcugcgcgcaaagacagcggcagcccgaaccccgcccgcggccacagcgucugcuccaccuccagcuuguaccugcaggaucugagcgccgccgccucagagugcaucgaccccucgguggucuuccccuacccucucaacgacagcagcucgcccaaguccugcgccucgcaagacuccagcgccuucucuccguccucggauucucugcucuccucgacggaguccuccccgcagggcagccccgagccccuggugcuccaugaggagacaccgcccaccaccagcagcgacucuggaggaacaagaagauga

SEQ ID NO: 9853 - RNA, 774 nt, Artificial Sequence
  derived and/or modified sequence opt1 from c-myc__Homo_sapiens__EAW92099
augccccugaacgugagcuucaccaaccgcaacuacgaccucgacuacgacuccguccagcccuacuucuacugcgacgaggaggagaacuucuaccagcagcagcagcagagcgagcugcagccgcccgcccccuccgaggacaucuggaagaaguucgagcugcucccgaccccgccccugagccccucccggcgcagcggccugugcucccccagcuacguggccgugacgcccuucucccuccgcggggacaacgacggcgggggcgggagcuucuccaccgcggaccagcuggagauggucaccgagcugcucggcggcgacauggugaaccagagcuucaucugcgaccccgacgacgagaccuucaucaagaacaucaucauccaggacugcaugugguccggguucagcgccgccgccaagcugguguccgagaagcuggccagcuaccaggcggcccggaaggacuccggcagccccaacccggcccgggggcacuccgucugcagcacgagcucccucuaccugcaggaccugagcgccgcggccuccgagugcaucgaccccagcgugguguuccccuacccccucaacgacuccagcucccccaagagcugcgccucccaggacagcuccgccuucagccccuccagcgacucccugcugagcuccaccgagagcagcccccagggcucccccgagccgcucguccugcacgaggagaccccgcccaccacgagcuccgacagcgggggcacccgccgguga

SEQ ID NO: 9854 - RNA, 774 nt, Artificial Sequence
  derived and/or modified sequence opt2 from c-myc__Homo_sapiens__EAW92099
augccccucaacgucuccuucaccaaccgcaacuacgaccucgacuacgacuccguccagcccuacuucuacugcgacgaggaggagaacuucuaccagcagcagcagcaguccgagcuccagccccccgcccccuccgaggacaucuggaagaaguucgagcuccuccccacccccccccucucccccucccgccgcuccggccucugcucccccuccuacgucgccgucacccccuucucccuccgcggcgacaacgacggcggcggcggcuccuucuccaccgccgaccagcucgagauggucaccgagcuccucggcggcgacauggucaaccaguccuucaucugcgaccccgacgacgagaccuucaucaagaacaucaucauccaggacugcaugugguccggcuucuccgccgccgccaagcucgucuccgagaagcucgccuccuaccaggccgcccgcaaggacuccggcucccccaaccccgcccgcggccacuccgucugcuccaccuccucccucuaccuccaggaccucuccgccgccgccuccgagugcaucgaccccuccgucgucuuccccuacccccucaacgacuccuccucccccaaguccugcgccucccaggacuccuccgccuucucccccuccuccgacucccuccucuccuccaccgaguccuccccccagggcucccccgagccccucguccuccacgaggagaccccccccaccaccuccuccgacuccggcggcacccgccgcuga

SEQ ID NO: 9855 - RNA, 774 nt, Artificial Sequence
  derived and/or modified sequence opt3 from c-myc__Homo_sapiens__EAW92099
augccccugaacgugagcuucaccaauagaaacuacgaccucgauuaugacuccguccagccuuacuuuuauugcgaugaggaagagaauuucuaccaacagcagcagcaaucugaacuucagccaccggcccccucagaggacaucuggaagaaauuugaacuguugccuacaccacccuuaaguccuagcaggcgguccggccuguguucuccaucguauguugcugugacucccuucucacuacgcggggauaacgacggagguggcgggagcuuuaguacggcagaucagcucgagaugguaaccgagcugcuuggaggcgacauggugaaucaguccuucauuugcgauccugacgaugaaacauuuauaaagaacaucauuauccaagacuguauguggucugguuucagcgccgcggcuaaacuggucuccgagaaguuggccucauaccaggcagcccgaaaagauagugggagcccaaauccggcucguggacacucugugugcuccacuucaagccucuaucugcaggaccugagugcagccgcuucugaauguauugaccccuccguuguguuuccuuacccacucaacgauagcucgucucccaaguccugcgccucacaggacaguagcgcguucuccccuucuagcgauucauuacugaguuccaccgagagcucuccacaaggcucacccgagccgcuugucuugcaugaagagacaccucccaccacaaguagcgacuccggcgggacuagaagguga

SEQ ID NO: 9856 - RNA, 774 nt, Artificial Sequence
  derived and/or modified sequence opt4 from c-myc__Homo_sapiens__EAW92099
augccccugaacgugagcuucaccaacagaaacuacgaccuggacuacgacagcgugcagcccuacuucuacugcgacgaggaggagaacuucuaccagcagcagcagcagagcgagcugcagccccccgcccccagcgaggacaucuggaagaaguucgagcugcugcccacccccccccugagccccagcagaagaagcggccugugcagccccagcuacguggccgugacccccuucagccugagaggcgacaacgacggcggcggcggcagcuucagcaccgccgaccagcuggagauggugaccgagcugcugggcggcgacauggugaaccagagcuucaucugcgaccccgacgacgagaccuucaucaagaacaucaucauccaggacugcauguggagcggcuucagcgccgccgccaagcuggugagcgagaagcuggccagcuaccaggccgccagaaaggacagcggcagccccaaccccgccagaggccacagcgugugcagcaccagcagccuguaccugcaggaccugagcgccgccgccagcgagugcaucgaccccagcgugguguuccccuacccccugaacgacagcagcagccccaagagcugcgccagccaggacagcagcgccuucagccccagcagcgacagccugcugagcagcaccgagagcagcccccagggcagccccgagccccuggugcugcacgaggagaccccccccaccaccagcagcgacagcggcggcaccagaagauga

SEQ ID NO: 9857 - RNA, 774 nt, Artificial Sequence
  derived and/or modified sequence opt5 from c-myc__Homo_sapiens__EAW92099
augccccugaacgugagcuucaccaauagaaacuacgaccucgauuaugacuccguccagccuuacuuuuauugcgaugaggaagagaauuucuaccaacagcagcagcaaucugaacugcagccgcccgccccuagcgaggacaucuggaagaaauuugaacuucugcccacaccuccccucuccccuucucggcgcagcggccuguguuccccgucuuauguugcugugacgcccuucagccuuagaggggauaacgacggaggcgggggauccuuuagcaccgccgaucagcuggagauggugacagagcuccugggcggggacauggucaaucagucuuucauuugcgauccugacgaugaaaccuuuaucaagaacauuaucauucaagacuguaugugguccggauucagcgcggcugccaaacuggugucugagaagcucgccuccuaccaggcugcccggaaagauagcggcucucccaauccugcucgcggccacuccguuugcagcacauccucucuguaucuucaggaccugagcgccgcggccuccgaauguaucgaccccagcguggucuuuccguacccucucaacgauucuuccagccccaagucuugcgcuagccaggacuccucugccuucagcccuuccagcgauucucugcuuuccagcaccgagucuagcccccaagggucccccgagccucuggugcuccaugaagagacaccgcccaccacguccucugacagcggaggcaccagacgguga

SEQ ID NO: 9858 - RNA, 774 nt, Artificial Sequence
  derived and/or modified sequence opt6 from c-myc__Homo_sapiens__EAW92099
augccacuaaacguaucuuucacaaauagaaacuacgaccuagacuacgacucaguacaaccauacuuuuacugcgacgaagaagaaaacuucuaccaacaacaacaacaaucagaacuacaaccacccgcaccauccgaagacaucuggaaaaaauucgaauuacuaccaacaccacccuuaucaccaucaagaagaucaggacuauguucaccauccuacguagcuguaacaccauucucacuaagaggagacaacgauggaggaggaggaucauucucaacagcagaccaacuagaaaugguaacagaacuacucggaggcgacaugguaaaucaaucauucauaugcgaccccgacgaugaaacauucaucaaaaauaucauaauacaagacugcauguggucaggauucucagcagcugcaaaacucguaucagaaaaacuagccucauaccaagcagcaagaaaagacucaggaucaccaaacccagcaagaggacacucaguaugcucaacaucaucauuauaccuacaagacuuaucagcagcagcaucagaaugcauagacccaucagucguauucccauacccacuaaacgacucaucuucaccuaaauccugcgcaucacaagauucaucagcauucucaccaucaucagacucacuacuaucaucaacagaaucaucaccccaaggcucaccagaaccauuaguauuacacgaagaaacaccaccaacaaccucaucugacucuggaggaacaagaagauaa

SEQ ID NO: 9859 - protein, 439 aa, Artificial Sequence
  c-myc__Homo_sapiens__P01106
MPLNVSFTNRNYDLDYDSVQPYFYCDEEENFYQQQQQSELQPPAPSEDIWKKFELLPTPPLSPSRRSGLCSPSYVAVTPFSLRGDNDGGGGSFSTADQLEMVTELLGGDMVNQSFICDPDDETFIKNIIIQDCMWSGFSAAAKLVSEKLASYQAARKDSGSPNPARGHSVCSTSSLYLQDLSAAASECIDPSVVFPYPLNDSSSPKSCASQDSSAFSPSSDSLLSSTESSPQGSPEPLVLHEETPPTTSSDSEEEQEDEEEIDVVSVEKRQAPGKRSESGSPSAGGHSKPPHSPLVLKRCHVSTHQHNYAAPPSTRKDYPAAKRVKLDSVRVLRQISNNRKCTSPRSSDTEENVKRRTHNVLERQRRNELKRSFFALRDQIPELENNEKAPKVVILKKATAYILSVQAEEQKLISEEDLLRKRREQLKHKLEQLRNSCA

SEQ ID NO: 9860 - RNA, 1320 nt, Artificial Sequence
  c-myc__Homo_sapiens__AAA36340
augccccucaacguuagcuucaccaacaggaacuaugaccucgacuacgacucggugcagccguauuucuacugcgacgaggaggagaacuucuaccagcagcagcagcagagcgagcugcagcccccggcgcccagcgaggauaucuggaagaaauucgagcugcugcccaccccgccccuguccccuagccgccgcuccgggcucugcucgcccuccuacguugcggucacacccuucucccuucggggagacaacgacggcgguggcgggagcuucuccacggccgaccagcuggagauggugaccgagcugcugggaggagacauggugaaccagaguuucaucugcgacccggacgacgagaccuucaucaaaaacaucaucauccaggacuguauguggagcggcuucucggccgccgccaagcucgucucagagaagcuggccuccuaccaggcugcgcgcaaagacagcggcagcccgaaccccgcccgcggccacagcgucugcuccaccuccagcuuguaccugcaggaucugagcgccgccgccucagagugcaucgaccccucgguggucuuccccuacccucucaacgacagcagcucgcccaaguccugcgccucgcaagacuccagcgccuucucuccguccucggauucucugcucuccucgacggaguccuccccgcagggcagccccgagccccuggugcuccaugaggagacaccgcccaccaccagcagcgacucugaggaggaacaagaagaugaggaagaaaucgauguuguuucuguggaaaagaggcaggcuccuggcaaaaggucagagucuggaucaccuucugcuggaggccacagcaaaccuccucacagcccacugguccucaagaggugccacgucuccacacaucagcacaacuacgcagcgccucccuccacucggaaggacuauccugcugccaagagggucaaguuggacagugucagaguccugagacagaucagcaacaaccgaaaaugcaccagccccagguccucggacaccgaggagaaugucaagaggcgaacacacaacgucuuggagcgccagaggaggaacgagcuaaaacggagcuuuuuugcccugcgugaccagaucccggaguuggaaaacaaugaaaaggcccccaagguaguuauccuuaaaaaagccacagcauacauccuguccguccaagcagaggagcaaaagcucauuucugaagaggacuuguugcggaaacgacgagaacaguugaaacacaaacuugaacagcuacggaacucuugugcguaa

SEQ ID NO: 9861 - RNA, 1320 nt, Artificial Sequence
  derived and/or modified sequence opt1 from c-myc__Homo_sapiens__AAA36340
augccccugaacgugagcuucaccaaccgcaacuacgaccucgacuacgacuccguccagccguacuucuacugcgacgaggaggagaacuucuaccagcagcagcagcagagcgagcugcagccgcccgcccccuccgaggacaucuggaagaaguucgagcugcucccgaccccgccccugagccccucccggcgcagcggccugugcucccccagcuacguggccgugacgcccuucucccuccgcggggacaacgacggcgggggcgggagcuucuccaccgcggaccagcuggagauggucaccgagcugcucggcggcgacauggugaaccagagcuucaucugcgaccccgacgacgagaccuucaucaagaacaucaucauccaggacugcaugugguccggguucagcgccgccgccaagcugguguccgagaagcuggccagcuaccaggcggcccggaaggacuccggcagccccaacccggcccgggggcacuccgucugcagcacgagcucccucuaccugcaggaccugagcgccgcggccuccgagugcaucgaccccagcgugguguuccccuacccccucaacgacuccagcucccccaagagcugcgccucccaggacagcuccgccuucagccccuccagcgacucccugcugagcuccaccgagagcagcccccagggcucccccgagccgcucguccugcacgaggagaccccgcccaccacgagcuccgacagcgaggaggagcaggaggacgaggaggagaucgacgugguguccgucgagaagcgccaggcccccgggaagcggagcgaguccggcagccccuccgcgggcgggcacagcaagccgccccacagcccccuggugcucaagcgcugccacguguccacccaccagcacaacuacgccgccccgcccuccacccggaaggacuaccccgccgccaagcgcgucaagcuggacagcgugcgggugcugcgccagaucuccaacaaccggaagugcaccagcccccgcuccagcgacacggaggagaacgucaagcggcgcacccacaacgugcucgagcggcagcgccggaacgagcugaagcgcuccuucuucgcgcugcgggaccagauccccgagcucgagaacaacgagaaggcccccaagguggucauccugaagaaggccaccgccuacauccugagcgugcaggccgaggagcagaagcucaucagcgaggaggaccugcugcgcaagcgccgggagcagcucaagcacaagcuggagcagcugcgcaacuccugcgcguga

SEQ ID NO: 9862 - RNA, 1320 nt, Artificial Sequence
  derived and/or modified sequence opt2 from c-myc__Homo_sapiens__AAA36340
augccccucaacgucuccuucaccaaccgcaacuacgaccucgacuacgacuccguccagcccuacuucuacugcgacgaggaggagaacuucuaccagcagcagcagcaguccgagcuccagccccccgcccccuccgaggacaucuggaagaaguucgagcuccuccccacccccccccucucccccucccgccgcuccggccucugcucccccuccuacgucgccgucacccccuucucccuccgcggcgacaacgacggcggcggcggcuccuucuccaccgccgaccagcucgagauggucaccgagcuccucggcggcgacauggucaaccaguccuucaucugcgaccccgacgacgagaccuucaucaagaacaucaucauccaggacugcaugugguccggcuucuccgccgccgccaagcucgucuccgagaagcucgccuccuaccaggccgcccgcaaggacuccggcucccccaaccccgcccgcggccacuccgucugcuccaccuccucccucuaccuccaggaccucuccgccgccgccuccgagugcaucgaccccuccgucgucuuccccuacccccucaacgacuccuccucccccaaguccugcgccucccaggacuccuccgccuucucccccuccuccgacucccuccucuccuccaccgaguccuccccccagggcucccccgagccccucguccuccacgaggagaccccccccaccaccuccuccgacuccgaggaggagcaggaggacgaggaggagaucgacgucgucuccgucgagaagcgccaggcccccggcaagcgcuccgaguccggcucccccuccgccggcggccacuccaagcccccccacuccccccucguccucaagcgcugccacgucuccacccaccagcacaacuacgccgccccccccuccacccgcaaggacuaccccgccgccaagcgcgucaagcucgacuccguccgcguccuccgccagaucuccaacaaccgcaagugcaccuccccccgcuccuccgacaccgaggagaacgucaagcgccgcacccacaacguccucgagcgccagcgccgcaacgagcucaagcgcuccuucuucgcccuccgcgaccagauccccgagcucgagaacaacgagaaggcccccaaggucgucauccucaagaaggccaccgccuacauccucuccguccaggccgaggagcagaagcucaucuccgaggaggaccuccuccgcaagcgccgcgagcagcucaagcacaagcucgagcagcuccgcaacuccugcgccuga

SEQ ID NO: 9863 - RNA, 1320 nt, Artificial Sequence
  derived and/or modified sequence opt3 from c-myc__Homo_sapiens__AAA36340
augccccugaacgugagcuucaccaauagaaacuacgaccucgauuaugacuccguccagccuuacuuuuauugcgaugaggaagagaauuucuaccaacagcagcagcaaucugaacuucagccaccggcccccucagaggacaucuggaagaaauuugaacuguugccuacaccacccuuaaguccuagcaggcgguccggccuguguucuccaucguauguugcugugacucccuucucacuacgcggggauaacgacggagguggcgggagcuuuaguacggcagaucagcucgagaugguaaccgagcugcuuggaggcgacauggugaaucaguccuucauuugcgauccugacgaugaaacauuuauaaagaacaucauuauccaagacuguauguggucugguuucagcgccgcggcuaaacuggucuccgagaaguuggccucauaccaggcagcccgaaaagauagugggagcccaaauccggcucguggacacucugugugcuccacuucaagccucuaucugcaggaccugagugcagccgcuucugaauguauugaccccuccguuguguuuccuuacccacucaacgauagcucgucucccaaguccugcgccucacaggacaguagcgcguucuccccuucuagcgauucauuacugaguuccaccgagagcucuccacaaggcucacccgagccgcuugucuugcaugaagagacaccucccaccacaaguagcgacuccgaagaggaacaggaggaugaggaagagaucgacgugguaucuguugaaaagagacaggcaccaggcaaaaggucggagagcggguccccuucagccggaggucacaguaagcccccacauucuccccuggugcuaaaacggugucacgucagcacucaucaacacaauuacgcugccccuccauccacccgcaaggauuauccggcagcuaaaagagugaagcucgacucagugaggguccugcggcagauaagcaacaaucgcaagugcacgucuccccgauccagugauacugaagagaacguuaaaagaaggacccacaaugugcuugagcggcagcgucgcaacgaacugaagaggagcuuuuucgccuugagagaccagaucccugagcucgaaaauaacgagaaagcgccaaagguagugauucugaaaaaggccacagcauacaucuuaucuguccaagcugaggaacagaaacugauuuccgaggaagaucuccuucggaagcgacgcgagcagcugaagcauaaauuggaacagcuaagaaacucaugugccuga

SEQ ID NO: 9864 - RNA, 1320 nt, Artificial Sequence
  derived and/or modified sequence opt4 from c-myc__Homo_sapiens__AAA36340
augccccugaacgugagcuucaccaacagaaacuacgaccuggacuacgacagcgugcagcccuacuucuacugcgacgaggaggagaacuucuaccagcagcagcagcagagcgagcugcagccccccgcccccagcgaggacaucuggaagaaguucgagcugcugcccacccccccccugagccccagcagaagaagcggccugugcagccccagcuacguggccgugacccccuucagccugagaggcgacaacgacggcggcggcggcagcuucagcaccgccgaccagcuggagauggugaccgagcugcugggcggcgacauggugaaccagagcuucaucugcgaccccgacgacgagaccuucaucaagaacaucaucauccaggacugcauguggagcggcuucagcgccgccgccaagcuggugagcgagaagcuggccagcuaccaggccgccagaaaggacagcggcagccccaaccccgccagaggccacagcgugugcagcaccagcagccuguaccugcaggaccugagcgccgccgccagcgagugcaucgaccccagcgugguguuccccuacccccugaacgacagcagcagccccaagagcugcgccagccaggacagcagcgccuucagccccagcagcgacagccugcugagcagcaccgagagcagcccccagggcagccccgagccccuggugcugcacgaggagaccccccccaccaccagcagcgacagcgaggaggagcaggaggacgaggaggagaucgacguggugagcguggagaagagacaggcccccggcaagagaagcgagagcggcagccccagcgccggcggccacagcaagcccccccacagcccccuggugcugaagagaugccacgugagcacccaccagcacaacuacgccgccccccccagcaccagaaaggacuaccccgccgccaagagagugaagcuggacagcgugagagugcugagacagaucagcaacaacagaaagugcaccagccccagaagcagcgacaccgaggagaacgugaagagaagaacccacaacgugcuggagagacagagaagaaacgagcugaagagaagcuucuucgcccugagagaccagauccccgagcuggagaacaacgagaaggcccccaagguggugauccugaagaaggccaccgccuacauccugagcgugcaggccgaggagcagaagcugaucagcgaggaggaccugcugagaaagagaagagagcagcugaagcacaagcuggagcagcugagaaacagcugcgccuga

SEQ ID NO: 9865 - RNA, 1320 nt, Artificial Sequence
  derived and/or modified sequence opt5 from c-myc__Homo_sapiens__AAA36340
augccccugaacgugagcuucaccaauagaaacuacgaccucgauuaugacuccguccagccuuacuuuuauugcgaugaggaagagaauuucuaccaacagcagcagcaaucugaacugcagccgcccgccccuagcgaggacaucuggaagaaauuugaacuucugcccacaccuccccucuccccuucucggcgcagcggccuguguuccccgucuuauguugcugugacgcccuucagccuuagaggggauaacgacggaggcgggggauccuuuagcaccgccgaucagcuggagauggugacagagcuccugggcggggacauggucaaucagucuuucauuugcgauccugacgaugaaaccuuuaucaagaacauuaucauucaagacuguaugugguccggauucagcgcggcugccaaacuggugucugagaagcucgccuccuaccaggcugcccggaaagauagcggcucucccaauccugcucgcggccacuccguuugcagcacauccucucuguaucuucaggaccugagcgccgcggccuccgaauguaucgaccccagcguggucuuuccguacccucucaacgauucuuccagccccaagucuugcgcuagccaggacuccucugccuucagcccuuccagcgauucucugcuuuccagcaccgagucuagcccccaagggagccccgagccucuggugcuccaugaagagacaccgcccaccacguccucugacagcgaagaggaacaggaggaugaggaagagaucgacguuguguccgucgaaaagagacaggcuccuggaaaacggucugagagcggcucccccagcgccgggggacacucuaagccuccccauuccccgcuggugcugaaacgcugucacgugagcacccaucaacacaauuacgcggccccucccucuacaagaaaggauuauccugcugccaaacgggucaagcucgacuccguucgcgugcugagacagauuagcaacaaucggaagugcaccucuccccgcagcuccgauacagaagagaacgugaaaagacggacccacaauguccuugagcgccagagacggaacgaacugaagagauccuuuuucgcucuccgcgaccagaucccugagcuggaaaauaacgagaaagcccccaaggugguuauucuuaaaaaggccacggcuuacauccugucugugcaagcggaggaacagaaacucauuuccgaggaagaucugcugcggaagagacgcgagcagcucaagcauaaacuggaacagcuucggaacagcugugccuga

SEQ ID NO: 9866 - RNA, 1320 nt, Artificial Sequence
  derived and/or modified sequence opt6 from c-myc__Homo_sapiens__AAA36340
augccauuaaacgucucuuucacaaacagaaauuacgaccuagacuacgauucaguacaaccauauuuuuacugcgacgaagaagaaaacuucuaucaacaacaacaacaaucagaacuccaaccaccagcucccucugaagacaucuggaaaaaauucgaacuauuaccaacaccaccauuaucuccuucacgaagaucaggucuaugcucaccaucauacguagccguuaccccauucucauuacguggcgauaacgauggaggcggaggaucauucucaacagcugaucaauuagaaauggucacagaacuacucggaggugauaugguuaaucaaagcuucauuugugauccagaugacgaaacauucauaaaaaacauuauaauacaagauugcauguggucaggauucucagcagcagcaaaauuaguaucagaaaaacuagcuucauaucaagcagcaagaaaagauuccggcucaccaaaccccgcacgaggacauucaguaugcagcaccucaucauuauacuuacaagaccucucagcugcagcaucagaaugcauagacccauccguaguauuuccauacccacuuaacgauucuucaucaccaaaaucaugcgcaucccaagauucaagugcauucucaccgucaucagacucauuacucucauccacagaaucuagcccucaaggaucaccagaaccauuaguauuacaugaagaaacaccaccaacaacaucaucagacuccgaagaagaacaagaagacgaagaagaaauugacguaguuucaguagaaaaaagacaagcacccggaaaacgaucagaaucagguucacccucagcaggaggccacagcaaaccaccacacucaccacuaguauuaaaaagaugccacguaucaacacaccaacacaacuacgcagcaccaccaucaacaagaaaagauuacccugcagcaaaaagagucaaacuagacucagucagaguauuacgccaaauaucaaauaauagaaaaugcacaucaccaagaucauccgacacagaagaaaacguaaaacgacgaacacauaacguacuagaaagacaaagaagaaacgaacuaaaacgauccuucuucgcauuacgagaccaaauccccgaacuagaaaacaacgaaaaagcaccaaaaguaguuauucuaaaaaaagcaacagcuuacauacucucaguacaagccgaagaacaaaaauuaaucucugaagaagaucuacucagaaaaagacgcgaacaacuaaaacacaaacuagaacaacuaagaaauucaugcgcauaa

SEQ ID NO: 9867 - protein, 188 aa, Artificial Sequence [sequence omitted]

SEQ ID NO: 9868 - RNA, 567 nt, Artificial Sequence
  c-myc__Homo_sapiens__AAA59886
augcgagggucuggacggcugaggacccccgagcuggucugcucgcggccgccaccgccgggccccggccgucccuggcuccccuccugccucgagaagggcagggcuucucagaggcuuggcgggaaaaagaacggagggagggaucgcgcugaguauaaaagccgguuuucggggcuuuaucuaacucgcuguaguaauuccagcgagaggcagagggagcgagcgggcggccggcuaggguggaagagccgggcgagcagagcugcgcugcgggcguccugggaagggagauccggagcgaauagggggcuucgccucuggcccagcccucccgcugaucccccagccagccguccgcaacccuugccgcauccacgaaacuuugcccauagcagcgggcgggcacuuugcacuggaacuuacaacacccgagcaaggacgcgacucucccgacgcggggaggcuauucugcccauuuggggacacuuccccgccgcugccaggacccgcuucucugaaaggcucuccuugcagcugcuuagacgcuggauuuuuuucggguag

SEQ ID NO: 9869 - RNA, 567 nt, Artificial Sequence
  derived and/or modified sequence opt1 from c-myc__Homo_sapiens__AAA59886
augcgcggcagcgggcggcugcgcacccccgagcucgugugcucccggccgcccccgcccggccccgggcgccccuggcugcccagcugccuggagaagggccgggccucccagcgccucgggggcaagaagaacggcgggcgggaccgcgccgaguacaagagccgguucuccggccuguaccugacccgcugcagcaacuccagcgagcggcagcgcgagcgggccgggggccgccucggguggaagucccgggcgagccgcgccgcccugcgggccuccugggagggccgcagcggcgcgaaccgggggcugcgccucuggcccuccccgcccgccgacccgcccgccagccggccccagccccugccccacccccgcaacuucgcccacuccagcggccgcgcgcugugcacggggaccuacaacacccgggcccgcacccggcucucccgccggggcgaggccauccugccgaucuggggccacuuccccgccgccgcgcgcacgcgguucagcgagcgccugucccuccagcugcugcggcgcuggaucuucuucggguga

SEQ ID NO: 9870 - RNA, 567 nt, Artificial Sequence
  derived and/or modified sequence opt2 from c-myc__Homo_sapiens__AAA59886
augcgcggcuccggccgccuccgcacccccgagcucgucugcucccgcccccccccccccggccccggccgccccuggcuccccuccugccucgagaagggccgcgccucccagcgccucggcggcaagaagaacggcggccgcgaccgcgccgaguacaagucccgcuucuccggccucuaccucacccgcugcuccaacuccuccgagcgccagcgcgagcgcgccggcggccgccucggcuggaagucccgcgccucccgcgccgcccuccgcgccuccugggagggccgcuccggcgccaaccgcggccuccgccucuggcccuccccccccgccgacccccccgccucccgcccccagccccucccccacccccgcaacuucgcccacuccuccggccgcgcccucugcaccggcaccuacaacacccgcgcccgcacccgccucucccgccgcggcgaggccauccuccccaucuggggccacuuccccgccgccgcccgcacccgcuucuccgagcgccucucccuccagcuccuccgccgcuggaucuucuucggcuga

SEQ ID NO: 9871 - RNA, 567 nt, Artificial Sequence
  derived and/or modified sequence opt3 from c-myc__Homo_sapiens__AAA59886
augagaggcagcgggaggcugcggacccccgagcucgugugcucccgcccuccaccgcccggaccuggucgaccauggcuucccucuugucuggaaaagggccgugccucacagagauugggagggaaaaagaacggcgguagggaccgggcugaguacaaaagucgcuucagcggguuauaucugacaagaugcuccaauucuucggaaaggcaacgggagcgcgcaggaggccgacuaggcuggaagucaagagccagcagggcggcucuccgggccaguugggaagggcguuccggagcaaaccgcggucugagacuuuggccuucuccacccgccgauccuccagcuagcaggccgcagccccugccucacccacggaauuuugcacauuccucaggccgagccuuguguacugggacguacaacacccgcgcuagaacaaggcucagucggcgcggagaggccauccugcccauuuggggccacuucccugcggcagccagaacuagguuuagcgagcgucugucucuccaguuacugcggcgauggauauucuuugguuga

SEQ ID NO: 9872 - RNA, 567 nt, Artificial Sequence
  derived and/or modified sequence opt4 from c-myc__Homo_sapiens__AAA59886
augagaggcagcggcagacugagaacccccgagcuggugugcagcagaccccccccccccggccccggcagacccuggcugcccagcugccuggagaagggcagagccagccagagacugggcggcaagaagaacggcggcagagacagagccgaguacaagagcagauucagcggccuguaccugaccagaugcagcaacagcagcgagagacagagagagagagccggcggcagacugggcuggaagagcagagccagcagagccgcccugagagccagcugggagggcagaagcggcgccaacagaggccugagacuguggcccagcccccccgccgacccccccgccagcagaccccagccccugccccaccccagaaacuucgcccacagcagcggcagagcccugugcaccggcaccuacaacaccagagccagaaccagacugagcagaagaggcgaggccauccugcccaucuggggccacuuccccgccgccgccagaaccagauucagcgagagacugagccugcagcugcugagaagauggaucuucuucggcuga

SEQ ID NO: 9873 - RNA, 567 nt, Artificial Sequence
  derived and/or modified sequence opt5 from c-myc__Homo_sapiens__AAA59886
augagaggcagcgggcggcugcgcacccccgagcucgugugcuccagaccuccgcccccuggacccggccggccuuggcugcccucuugucuugaaaaggggcgcgccagccagagacugggaggcaagaagaacgggggacgggaccgcgcugaguacaaauccagauucucuggccucuaucugacacggugcagcaauuccucugaacgccaaagagagcgggccggcgggcgccuuggauggaaaagcagagcgucccgggcugcccugcgcgccagcugggaaggcagaucuggggcuaaccggggacucagacuguggccuuccccgcccgccgauccucccgcuagccgcccucagccccugccgcacccucggaauuuugcccauucuuccggcagagcgcucuguacggggaccuacaacacacgcgcccggaccagacugagccgccggggagaggcuauccuucccauuuggggccacuucccugccgcugccagaacacgcuuuucugagcggcugucccuccagcugcuuagacgcuggaucuucuuuggcuga

SEQ ID NO: 9874 - RNA, 567 nt, Artificial Sequence
  derived and/or modified sequence opt6 from c-myc__Homo_sapiens__AAA59886
augagagguaguggaagauuaagaacaccagaauuaguauguagcagaccaccaccaccaggaccaggaagaccaugguuaccaagcuguuuagaaaaaggaagagcaagccagagacuaggaggaaaaaaaaauggaggaagagauagagcugaauauaaaaguagauuuucaggacuauauuuaacaagauguaguaacaguucagaaagacaaagagaaagagcaggaggaagauuaggauggaaaucaagagcaucaagggcagcauuaagagcaucaugggaaggaaggaguggagcaaaucgaggauuaagauuauggccaucaccaccagcagauccaccagcuaguagaccacaaccgcuaccacauccaagaaauuuugcacauucaagcggaagagcacuauguacuggaacauauaauacaagagcaagaacaagauuaaguagaagaggagaagcaauacuaccaauauggggacauuuuccagcagcagcaaggacacgauuuagugaaagauuaaguuuacaacuauuaagaagauggauauuuuuuggauaa

SEQ ID NO: 9875 - protein, 188 aa, Artificial Sequence
  c-myc__Homo_sapiens__Q16591
MRGSGRLRTPELCCSRPPPPGPGRPWLPSCLEKGRASQRLGGKKNGGRDRAEYKSRFSGLYLTRCSNSSERQRERAGGRLGWKSRASRAALRASWEGRSGANRGLRLWPSPPADPPASGPQPLPHPRNFAHSSGRALCTGTYNTRARTRLSRRGEAILPIWGHFPAAARTRFSERLSLQLLRRWIFFG

SEQ ID NO: 9876 - RNA, 567 nt, Artificial Sequence
  c-myc__Homo_sapiens__AAA59887
augcgagggucuggacggcugaggacccccgagcugugcugcucgcggccgccaccgccgggccccggccgucccuggcuccccuccugccucgagaagggcagggcuucucagaggcuuggcgggaaaaagaacggagggagggaucgcgcugaguauaaaagccgguuuucggggcuuuaucuaacucgcuguaguaauuccagcgagaggcagagggagcgagcgggcggccggcuaggguggaagagccgggcgagcagagcugcgcugcgggcguccugggaagggagauccggagcgaauagggggcuucgccucuggcccagcccucccgcugaucccccagccagcgguccgcaacccuugccgcauccacgaaacuuugcccauagcagcgggcgggcacuuugcacuggaacuuacaacacccgagcaaggacgcgacucucccgacgcggggaggcuauucugcccauuuggggacacuuccccgccgcugccaggacccgcuucucugaaaggcucuccuugcagcugcuuagacgcuggauuuuuuucggguag

SEQ ID NO: 9877 - RNA, 567 nt, Artificial Sequence
  derived and/or modified sequence opt1 from c-myc__Homo_sapiens__AAA59887
augcgcggcagcgggcggcugcgcacccccgagcucugcugcucccggccgcccccgcccggccccgggcgccccuggcugcccagcugccuggagaagggccgggccucccagcgccucgggggcaagaagaacggcgggcgggaccgcgccgaguacaagagccgguucuccggccuguaccugacccgcugcagcaacuccagcgagcggcagcgcgagcgggccgggggccgccucggguggaagucccgggcgagccgcgccgcccugcgggccuccugggagggccgcagcggcgcgaaccgggggcugcgccucuggcccuccccgcccgccgacccgcccgccagcggcccccagccccugccccacccccggaacuucgcccacuccagcgggcgcgcgcugugcacgggcaccuacaacacccgcgcccggacccgccucucccggcgcggcgaggccauccugccgaucugggggcacuuccccgccgccgcgcggacgcgcuucagcgagcggcugucccuccagcugcugcgccgguggaucuucuucggcuga

SEQ ID NO: 9878 - RNA, 567 nt, Artificial Sequence
  derived and/or modified sequence opt2 from c-myc__Homo_sapiens__AAA59887
augcgcggcuccggccgccuccgcacccccgagcucugcugcucccgcccccccccccccggccccggccgccccuggcuccccuccugccucgagaagggccgcgccucccagcgccucggcggcaagaagaacggcggccgcgaccgcgccgaguacaagucccgcuucuccggccucuaccucacccgcugcuccaacuccuccgagcgccagcgcgagcgcgccggcggccgccucggcuggaagucccgcgccucccgcgccgcccuccgcgccuccugggagggccgcuccggcgccaaccgcggccuccgccucuggcccuccccccccgccgacccccccgccuccggcccccagccccucccccacccccgcaacuucgcccacuccuccggccgcgcccucugcaccggcaccuacaacacccgcgcccgcacccgccucucccgccgcggcgaggccauccuccccaucuggggccacuuccccgccgccgcccgcacccgcuucuccgagcgccucucccuccagcuccuccgccgcuggaucuucuucggcuga

SEQ ID NO: 9879 - RNA, 567 nt, Artificial Sequence
  derived and/or modified sequence opt3 from c-myc__Homo_sapiens__AAA59887
augagaggcagcgggaggcugcggacccccgagcucugcuguucccgcccuccaccgcccggaccuggucgaccauggcuucccucuugccuggaaaagggccgugccucacagagauugggagggaaaaagaacggcgguagggaccgggcugaguacaaaagucgcuucagcggguuauaucugacaagauguuccaauucuucggaaaggcaacgggagcgcgcaggaggccgacuaggcuggaagucaagagccagcagggcggcucuccgggccaguugggaagggcguuccggagcaaaccgcggucugagacuuuggccuucuccacccgccgauccuccagcuagcggcccgcagccccugccucacccaaggaauuuugcacauuccucagggcgggccuugugcacuggaacguacaacacccgagcucgcacaagacucaguaggcggggcgaggccauccugcccauuuggggucacuucccugcggcagcccgcacuagauuuagcgagaggcugucucuccaguuacugcgucgguggauauucuuuggguga

SEQ ID NO: 9880 - RNA, 567 nt, Artificial Sequence
  derived and/or modified sequence opt4 from c-myc__Homo_sapiens__AAA59887
augagaggcagcggcagacugagaacccccgagcugugcugcagcagaccccccccccccggccccggcagacccuggcugcccagcugccuggagaagggcagagccagccagagacugggcggcaagaagaacggcggcagagacagagccgaguacaagagcagauucagcggccuguaccugaccagaugcagcaacagcagcgagagacagagagagagagccggcggcagacugggcuggaagagcagagccagcagagccgcccugagagccagcugggagggcagaagcggcgccaacagaggccugagacuguggcccagcccccccgccgacccccccgccagcggcccccagccccugccccaccccagaaacuucgcccacagcagcggcagagcccugugcaccggcaccuacaacaccagagccagaaccagacugagcagaagaggcgaggccauccugcccaucuggggccacuuccccgccgccgccagaaccagauucagcgagagacugagccugcagcugcugagaagauggaucuucuucggcuga

SEQ ID NO: 9881 - RNA, 567 nt, Artificial Sequence
  derived and/or modified sequence opt5 from c-myc__Homo_sapiens__AAA59887
augagaggcagcgggcggcugcgcacccccgagcucugcuguuccagaccuccgcccccuggacccggccggccuuggcugcccucuugccuugaaaaggggcgcgccagccagagacugggaggcaagaagaacgggggacgggaccgcgcugaguacaaauccagauucucuggccucuaucugacacgguguagcaauuccucugaacgccaaagagagcgggccggcgggcgccuuggauggaaaagcagagcgucccgggcugcccugcgcgccagcugggaaggcagaucuggggcuaaccggggacucagacuguggccuuccccgcccgccgauccucccgcuagcggcccucagccccugccgcacccucgcaauuuugcccauucuuccgggcgggcgcucugcacgggaaccuacaacacaagagcccgcacccggcugagcagacgcggcgaggcuauccuucccauuuggggccacuucccugccgcugcccggacaagauuuucugagcgccugucccuccagcugcuucggagauggaucuucuuuggguga

SEQ ID NO: 9882 - RNA, 567 nt, Artificial Sequence
  derived and/or modified sequence opt6 from c-myc__Homo_sapiens__AAA59887
augagaggaucaggaagacuaagaacaccagaauuaugcuguaguagaccaccaccaccaggaccaggaagaccaugguuaccaaguuguuuagaaaaaggaagagcgagucaaagauuaggaggaaaaaaaaauggaggaagagacagagcagaauauaaaagcagauuuucagguuuauauuuaacaagauguucaaauucaagugaaagacaaagagaaagagcaggaggaagacuaggauggaaaucaagagcaaguagagcagcauuaagagcaucgugggaaggaagaaguggagcaaauagaggauuaagauuauggccaucaccaccagcggauccaccagcaucaggaccacaaccauuaccacauccaagaaauuuugcacauaguaguggaagagcauuauguacaggaacauauaauacaagagcgagaacaagauuaagcagaagaggagaagcaauauuaccuauauggggacacuuuccagcagcagcaagaacaagauuuagugaaagacuaaguuuacaauuauuaagaagauggauauuuuuugguuaa

SEQ ID NO: 9883 - protein, 353 aa, Artificial Sequence
  Klf1__Homo_sapiens__K7VKE0
MATAETALPSISTLTALGPFPDTQDDFLKWWRSEEAQDMGPGPPDPTEPPLHVKSEDQPGEEEDDERGADATWDLDLLLTNFSGPEPGGAPQTCALAPSEASGAQYPPPPETLGAYAGGPGLVAGLLGSEDHSGWVRPALRARAPDAFVGPALAPAPAPEPKALALQPVYPGPGARRRLLGWLLPADRAFSACGVGRPLRATVRVPRDVPGASVPRALPALPRAPGTRARSRHVPLLPELFGTRDGGHWTRGDCRGSRCDSRDRAIQARPTFVGAQEAGSAHVRAPGLRQELHQELPPEGASAHAHRGEAIRLHVGRLRLEIRALGRADPPLPETHGAAPLPLPALPTCFFAL

SEQ ID NO: 9884 - RNA, 1062 nt, Artificial Sequence
  Klf1__Homo_sapiens__AFW90650
auggccacagccgagaccgccuugcccuccaucagcacacugaccgcccugggccccuucccggacacacaggaugacuuccucaagugguggcgcuccgaagaggcgcaggacaugggcccggguccuccugaccccacggagccgccccuccacgugaagucugaggaccagcccggggaggaagaggacgaugagaggggcgcggacgccaccugggaccuggaucuccuccucaccaacuucucgggcccggagcccgguggcgcgccccagaccugcgcucuggcgcccagcgaggccuccggggcgcaauauccgccgccgcccgagacucugggcgcauaugcuggcggcccggggcugguggcugggcuuuuggguucggaggaucacucggguugggugcgcccugcccugcgagcccgggcucccgacgccuucgugggcccagcccuggcuccagccccggcccccgagcccaaggcgcuggcgcugcaaccgguguacccggggcccggcgcccggcgccggcuccucggguggcuacuucccgcggaccgggcuuucagugccugcggcgucgggcgcccccuacgggcuacuguccggguaccccgcgauguacccggcgccucaguaccaagggcacuuccagcucuuccgcgggcuccagggacccgcgcccggucccgccacgucccccuccuuccugaguuguuugggacccgggacggugggcacuggacucggggggacugcagaggauccaggugugauagccgagaccgcgccauccaagcgaggccgacguucgugggcgcgcaagaggcaggcagcgcacacgugcgcgcacccggguugcggcaagagcuacaccaagagcucccaccugaaggcgcaucugcgcacgcacacaggggagaagccauacgccugcacgugggaaggcugcggcuggagauucgcgcgcucggacgagcugacccgccacuaccggaaacacacggggcagcgccccuuccgcugccagcucugcccacgugcuuuuucgcgcucuga

SEQ ID NO: 9885 - RNA, 1062 nt, Artificial Sequence
  derived and/or modified sequence opt1 from Klf1__Homo_sapiens__AFW90650
auggccaccgccgagaccgcgcugcccagcaucuccacgcucaccgcccugggccccuuccccgacacccaggacgacuuccugaagugguggcgcagcgaggaggcccaggacauggggcccgggcccccggaccccaccgagccgccccuccacgugaaguccgaggaccagcccggggaggaggaggacgacgagcggggcgccgacgccacgugggaccuggaccugcuccugaccaacuucagcgggcccgagcccggcggcgcgccccagaccugcgcccuggccccguccgaggccagcggggcgcaguacccgcccccgcccgagacccucggcgccuacgccgggggccccgggcuggucgccggccugcucggcuccgaggaccacagcgggugggugcgccccgcccugcgggcgcgcgcccccgacgccuucgugggccccgcccuggcccccgcgcccgcccccgagccgaaggcccucgcccugcagcccgucuaccccgggcccggcgcccggcgccggcugcucggcuggcugcugccggcggaccgcgccuucuccgccugcggggugggccggccccuccgcgccacggugcgggucccccgcgacgugccgggggccagcgugccccgggcgcugcccgcccugccccgcgccccgggcacccgggcccgcucccggcacgucccccuccugcccgagcuguucgggacccgcgacggcggccacuggacccggggcgacugccgcggcagccggugcgacucccgcgaccgcgcgauccaggcccggcccacguucgugggggcccaggaggccggcagcgcccacgugcgcgcgccggggcuccggcaggagcugcaccaggagcugccgcccgagggcgccuccgcccacgcccaccgcggcgaggccauccggcuccacgucgggcgccugcggcuggagauccgcgcgcucggccgggccgacccgccccugcccgagacccacggggccgcgccccugccccuccccgcccugccgaccugcuucuucgcccuguga

SEQ ID NO: 9886 - RNA, 1062 nt, Artificial Sequence
  derived and/or modified sequence opt2 from Klf1__Homo_sapiens__AFW90650
auggccaccgccgagaccgcccuccccuccaucuccacccucaccgcccucggccccuuccccgacacccaggacgacuuccucaagugguggcgcuccgaggaggcccaggacaugggccccggcccccccgaccccaccgagcccccccuccacgucaaguccgaggaccagcccggcgaggaggaggacgacgagcgcggcgccgacgccaccugggaccucgaccuccuccucaccaacuucuccggccccgagcccggcggcgccccccagaccugcgcccucgcccccuccgaggccuccggcgcccaguacccccccccccccgagacccucggcgccuacgccggcggccccggccucgucgccggccuccucggcuccgaggaccacuccggcuggguccgccccgcccuccgcgcccgcgcccccgacgccuucgucggccccgcccucgcccccgcccccgcccccgagcccaaggcccucgcccuccagcccgucuaccccggccccggcgcccgccgccgccuccucggcuggcuccuccccgccgaccgcgccuucuccgccugcggcgucggccgcccccuccgcgccaccguccgcgucccccgcgacguccccggcgccuccgucccccgcgcccuccccgcccucccccgcgcccccggcacccgcgcccgcucccgccacgucccccuccuccccgagcucuucggcacccgcgacggcggccacuggacccgcggcgacugccgcggcucccgcugcgacucccgcgaccgcgccauccaggcccgccccaccuucgucggcgcccaggaggccggcuccgcccacguccgcgcccccggccuccgccaggagcuccaccaggagcucccccccgagggcgccuccgcccacgcccaccgcggcgaggccauccgccuccacgucggccgccuccgccucgagauccgcgcccucggccgcgccgaccccccccuccccgagacccacggcgccgccccccucccccuccccgcccuccccaccugcuucuucgcccucuga

SEQ ID NO: 9887 - RNA, 1062 nt, Artificial Sequence
  derived and/or modified sequence opt3 from Klf1__Homo_sapiens__AFW90650
auggccaccgcugagacagcacugcccagcaucuccacucucacggcccuuggcccuuucccagacacccaggaugacuuucugaagugguggagaucugaagaggcgcaagauauggggccgggacccccugacccaacagaacccccuuugcacgugaaaucagaggaucagccaggugaagaggaggacgaugaaaggggcgcugacgccacuugggauuuagaccugcuacucaccaacuucagugggcccgagccuggaggcgcaccacagacaugcgcccuggcuccgagcgaagcauccggugcccaguaucccccuccacccgagacccuuggggcuuacgccggaggcccuggccuggucgcgggguugcucggaucugaggaucauucggguuggguucggccagcacugcgcgcccgagcucccgacgccuuugugggcccggcacuggcuccugcccccgcgccagaaccuaaggcccucgcauuacaacccguauacccagggcccggagcucguagaaggcugcuuggcugguugcugccugccgaucgggcuuucucagccugugguguggggcgcccacuaagagcaacugucagggugccgcgggacguucccggagccagcgugccucgcgcucucccagcgcugccccgagcaccuggcacaagagccaggagucggcacgucccacuucugcccgaguuguuuggcacccgugacgggggacauuggacgcgcggugauugcagaggcuccaggugugacucucgggaucgagcuauucaggcccgcccgacuuucgugggggcacaggaagccggaagcgcucacguaagagccccuggccucaggcaggagcugcaucaagaauuaccacccgagggugcauccgcgcacgcucaccgcggggaggccauacggcugcauguuggcagacucaggcuugaaauccgugcacugggacgggccgacccucccuugccagagacccacggcgcugccccucuaccccugccagcacucccgacaugcuuuuucgcucuguga

SEQ ID NO: 9888 - RNA, 1062 nt, Artificial Sequence
  derived and/or modified sequence opt4 from Klf1__Homo_sapiens__AFW90650
auggccaccgccgagaccgcccugcccagcaucagcacccugaccgcccugggccccuuccccgacacccaggacgacuuccugaagugguggagaagcgaggaggcccaggacaugggccccggcccccccgaccccaccgagcccccccugcacgugaagagcgaggaccagcccggcgaggaggaggacgacgagagaggcgccgacgccaccugggaccuggaccugcugcugaccaacuucagcggccccgagcccggcggcgccccccagaccugcgcccuggcccccagcgaggccagcggcgcccaguacccccccccccccgagacccugggcgccuacgccggcggccccggccugguggccggccugcugggcagcgaggaccacagcggcugggugagacccgcccugagagccagagcccccgacgccuucgugggccccgcccuggcccccgcccccgcccccgagcccaaggcccuggcccugcagcccguguaccccggccccggcgccagaagaagacugcugggcuggcugcugcccgccgacagagccuucagcgccugcggcgugggcagaccccugagagccaccgugagagugcccagagacgugcccggcgccagcgugcccagagcccugcccgcccugcccagagcccccggcaccagagccagaagcagacacgugccccugcugcccgagcuguucggcaccagagacggcggccacuggaccagaggcgacugcagaggcagcagaugcgacagcagagacagagccauccaggccagacccaccuucgugggcgcccaggaggccggcagcgcccacgugagagcccccggccugagacaggagcugcaccaggagcugccccccgagggcgccagcgcccacgcccacagaggcgaggccaucagacugcacgugggcagacugagacuggagaucagagcccugggcagagccgaccccccccugcccgagacccacggcgccgccccccugccccugcccgcccugcccaccugcuucuucgcccuguga

SEQ ID NO: 9889 - RNA, 1062 nt, Artificial Sequence
  derived and/or modified sequence opt5 from Klf1__Homo_sapiens__AFW90650
auggccaccgcugagacagcccugcccagcaucuccacgcucaccgcgcugggcccuuucccggacacacaggacgacuuucuuaagugguggagaucugaagaggcucaagauauggggcccggaccucccgacccuaccgaacccccucugcacgugaaaagcgaggaucagccgggcgaagaggaggacgaugaacggggagccgacgccacaugggaucucgaccugcuucugaccaacuucuccggacccgagccuggcggggcuccccagacaugcgcccucgcuccuucugaagccagcggagcgcaguaucccccgccucccgagacccugggcgccuacgcuggcgggccuggacuggucgccggccuccugggguccgaggaucauucuggauggguucgccccgcucuuagagcccgggcgcccgacgccuuugugggcccugcucuggccccggcucccgccccugaacccaaggcccucgcucugcaaccuguguaccccgggccgggagcgcgcagacggcuucugggcuggcuccugccugccgaucgcgcuuucagcgccuguggcgucgggagaccccugcgggccacggugcgcguuccuagagacgugcccggagcuuccgucccucgggcccuccccgcgcugccgcgcgcuccuggcaccagagcccggagccgccacgugccccuucugcccgagcucuuugggacaagagacggaggccauuggaccagaggggauugccggggaucucgcugugacucccgggauagagccauucaggcucgcccuacauucguuggcgcccaggaagcuggcagcgcccacgugcgggcgccggggcugagacaggagcuucaucaagaacugcccccugagggagccucugcucacgcccaccgcggcgaggcuauccggcuccaugucgggagacugcgccuggaaauucgggcccucgggagagcggaucccccucugcccgagacccacggcgccgcuccucuuccccugccggcccucccuacgugcuuuuucgcucuguga

SEQ ID NO: 9890 - RNA, 1062 nt, Artificial Sequence
  derived and/or modified sequence opt6 from Klf1__Homo_sapiens__AFW90650
auggcaacagcugaaacugcacuaccaucuauauccacuuuaacagcauuaggaccauucccagacacacaagaugauuuuuuaaaaugguggagaucagaagaagcacaagauaugggaccuggaccacccgaucccacagaaccuccucuacauguaaaaucagaagaccaaccaggagaagaagaagaugacgaaagaggagcagacgcaacaugggauuuagacuuauuacuaacuaauuucucaggaccagaaccagguggugcaccacaaacaugugcauuggcaccaucagaagcaucaggagcacaauacccaccaccaccagaaacacuaggagcauacgcuggaggaccuggauuaguagcuggauuguuaggaucagaagaccauucaggauggguuagacccgcacuuagagcucgagcaccagaugccuuuguaggaccugcacuugcaccagcaccagcaccugaaccaaaagcacuagcauuacaaccaguguauccaggaccaggagcaagaagacgauuauuaggaugguuauuaccagcagauagagcauuuucagcauguggagugggaaggccuuuaagagcuacuguaagaguaccaagagacguaccaggagcaucaguaccaagagcauuaccagcauuaccuagagcaccuggcacaagagcaagaagucgucauguaccauuauuaccagaauuauuugguacaagagaugguggacacuggacaagaggagauuguagaggauccagaugugauucacgagauagagcgauccaagcaagaccuacauuuguaggugcacaagaagcuggaagcgcgcauguaagagcacccgguuuaagacaagaauuacaucaagaauuaccaccagaaggagcaucagcacaugcacauagaggugaagcaauaagauuacauguaggaagauuacgauuagaaauaagagcacuagguagagcugacccuccauuaccagaaacacauggggcagcaccuuuaccacuaccagcacuaccaacuuguuuuuuugcacuuuaa

SEQ ID NO: 9891 - protein, 362 aa, Artificial Sequence
  Klf1__Homo_sapiens__Q13351
MATAETALPSISTLTALGPFPDTQDDFLKWWRSEEAQDMGPGPPDPTEPPLHVKSEDQPGEEEDDERGADATWDLDLLLTNFSGPEPGGAPQTCALAPSEASGAQYPPPPETLGAYAGGPGLVAGLLGSEDHSGWVRPALRARAPDAFVGPALAPAPAPEPKALALQPVYPGPGAGSSGGYFPRTGLSVPAASGAPYGLLSGYPAMYPAPQYQGHFQLFRGLQGPAPGPATSPSFLSCLGPGTVGTGLGGTAEDPGVIAETAPSKRGRRSWARKRQAAHTCAHPGCGKSYTKSSHLKAHLRTHTGEKPYACTWEGCGWRFARSDELTRHYRKHTGQRPFRCQLCPRAFSRSDHLALHMKRHL

SEQ ID NO: 9892 - RNA, 1089 nt, Artificial Sequence
  Klf1__Homo_sapiens__AAB51173
auggccacagccgagaccgccuugcccuccaucagcacacugaccgcccugggccccuucccggacacacaggaugacuuccucaagugguggcgcuccgaagaggcgcaggacaugggcccggguccuccugaccccacggagccgccccuccacgugaagucugaggaccagcccggggaggaagaggacgaugagaggggcgcggacgccaccugggaccuggaucuccuccucaccaacuucucgggcccggagcccgguggcgcgccccagaccugcgcucuggcgcccagcgaggccuccggggcgcaauauccgccgccgcccgagacucugggcgcauaugcuggcggcccggggcugguggcugggcuuuuggguucggaggaucacucggguugggugcgcccugcccugcgagcccgggcucccgacgccuucgugggcccagcccuggcuccagccccggcccccgagcccaaggcgcuggcgcugcaaccgguguacccggggcccggcgccggcuccucggguggcuacuucccgcggaccgggcuuucagugccugcggcgucgggcgcccccuacgggcuacuguccggguaccccgcgauguacccggcgccucaguaccaagggcacuuccagcucuuccgcgggcuccagggacccgcgcccggucccgccacgucccccuccuuccugaguuguuugggacccgggacggugggcacuggacucggggggacugcagaggauccaggugugauagccgagaccgcgccauccaagcgaggccgacguucgugggcgcgcaagaggcaggcagcgcacacgugcgcgcacccggguugcggcaagagcuacaccaagagcucccaccugaaggcgcaucugcgcacgcacacaggggagaagccauacgccugcacgugggaaggcugcggcuggagauucgcgcgcucggacgagcugacccgccacuaccggaaacacacggggcagcgccccuuccgcugccagcucugcccacgugcuuuuucgcgcucugaccaccuggccuugcacaugaagcgccaccuuuga

SEQ ID NO: 9893 - RNA, 1089 nt, Artificial Sequence
  derived and/or modified sequence opt1 from Klf1__Homo_sapiens__AAB51173
auggccaccgccgagaccgcgcugcccagcaucuccacgcucaccgcccugggcccguuccccgacacccaggacgacuuccugaagugguggcgcagcgaggaggcccaggacauggggcccgggcccccggaccccaccgagccgccccuccacgugaaguccgaggaccagcccggcgaggaggaggacgacgagcggggcgccgacgccacgugggaccuggaccugcuccugaccaacuucagcgggcccgagcccggcggcgcgccccagaccugcgcccuggccccguccgaggccagcggggcgcaguacccgcccccgcccgagacccucggcgccuacgccgggggccccgggcuggucgccggccugcucggcuccgaggaccacagcgggugggugcgccccgcccugcgggcgcgcgcccccgacgccuucgugggccccgcccuggcccccgcgcccgcccccgagccgaaggcccucgcccugcagcccgucuaccccgggcccggcgccggcuccagcgggggcuacuucccgcggacggggcuguccgugcccgcggccagcggcgcccccuacgggcuccuguccggcuacccggccauguaccccgcgccccaguaccagggccacuuccagcuguuccgcgggcuccagggccccgccccggggcccgccaccagccccuccuuccugagcugccugggccccgggaccgugggcaccggccucgggggcacggccgaggacccgggggucaucgccgagaccgcgcccuccaagcggggccgccggagcugggcccgcaagcggcaggccgcccacacgugcgcccaccccgggugcggcaaguccuacaccaagagcagccaccugaaggcgcaccuccgcacccacaccggcgagaagcccuacgccugcaccugggaggggugcggcuggcgguucgcccgcuccgacgagcugacccggcacuaccgcaagcacacggggcagcggccguuccgcugccagcugugcccccgggccuucagccgcuccgaccaccuggcccuccacaugaagcggcaccuguga

SEQ ID NO: 9894 - RNA, 1089 nt, Artificial Sequence
  derived and/or modified sequence opt2 from Klf1__Homo_sapiens__AAB51173
auggccaccgccgagaccgcccuccccuccaucuccacccucaccgcccucggccccuuccccgacacccaggacgacuuccucaagugguggcgcuccgaggaggcccaggacaugggccccggcccccccgaccccaccgagcccccccuccacgucaaguccgaggaccagcccggcgaggaggaggacgacgagcgcggcgccgacgccaccugggaccucgaccuccuccucaccaacuucuccggccccgagcccggcggcgccccccagaccugcgcccucgcccccuccgaggccuccggcgcccaguacccccccccccccgagacccucggcgccuacgccggcggccccggccucgucgccggccuccucggcuccgaggaccacuccggcuggguccgccccgcccuccgcgcccgcgcccccgacgccuucgucggccccgcccucgcccccgcccccgcccccgagcccaaggcccucgcccuccagcccgucuaccccggccccggcgccggcuccuccggcggcuacuucccccgcaccggccucuccguccccgccgccuccggcgcccccuacggccuccucuccggcuaccccgccauguaccccgccccccaguaccagggccacuuccagcucuuccgcggccuccagggccccgcccccggccccgccaccucccccuccuuccucuccugccucggccccggcaccgucggcaccggccucggcggcaccgccgaggaccccggcgucaucgccgagaccgcccccuccaagcgcggccgccgcuccugggcccgcaagcgccaggccgcccacaccugcgcccaccccggcugcggcaaguccuacaccaaguccucccaccucaaggcccaccuccgcacccacaccggcgagaagcccuacgccugcaccugggagggcugcggcuggcgcuucgcccgcuccgacgagcucacccgccacuaccgcaagcacaccggccagcgccccuuccgcugccagcucugcccccgcgccuucucccgcuccgaccaccucgcccuccacaugaagcgccaccucuga

SEQ ID NO: 9895 - RNA, 1089 nt, Artificial Sequence
  derived and/or modified sequence opt3 from Klf1__Homo_sapiens__AAB51173
auggccaccgcugagacagcacugcccagcaucuccacucucacggcccuuggcccuuucccagacacccaggaugacuuucugaagugguggagaucugaagaggcgcaagauauggggccgggacccccugacccaacagaacccccuuugcacgugaaaucagaggaucagccaggugaagaggaggacgaugaaaggggcgcugacgccacuugggauuuagaccugcuacucaccaacuucagugggcccgagccuggaggcgcaccacagacaugcgcccuggcuccgagcgaagcauccggugcccaguaucccccuccacccgagacccuuggggcuuacgccggaggcccuggccuggucgcgggguugcucggaucugaggaucauucggguuggguucggccagcacugcgcgcccgagcucccgacgccuuugugggcccggcacuggcuccugcccccgcgccagaaccuaaggcccucgcauuacaacccguauacccagggcccggagcuggcucaagcgguggguauuucccucguacuggacugagugugccagccgcuuccggcgccccguacggccuuuugucuggguaucccgcaauguacccugccccacaguaucagggacacuuucagcuguucagaggucuacaaggccccgcuccugggccagcgacaagccccuccuuucucucaugucugggaccgggcaccgucgguacggggcuuggcggaacugcagaggauccuggcgugauugccgaaaccgcuccaaguaaaagggggcggcgcagcugggccagaaagaggcaggcagcccauacaugcgcucaccccggaugugguaaaucuuacacuaaguccucacaucugaaggcccacuugcggacccacacaggcgagaaaccuuacgcaugcaccugggaaggguguggauggcgcuucgcgcgaagcgacgagcucacgagacauuauaggaagcacacuggccagcggcccuuucguugccagcuguguccacgcgcuuucaguagaucugaccauuuagcccugcacaugaaaaggcaccucuga

SEQ ID NO: 9896 - RNA, 1089 nt, Artificial Sequence
  derived and/or modified sequence opt4 from Klf1__Homo_sapiens__AAB51173
auggccaccgccgagaccgcccugcccagcaucagcacccugaccgcccugggccccuuccccgacacccaggacgacuuccugaagugguggagaagcgaggaggcccaggacaugggccccggcccccccgaccccaccgagcccccccugcacgugaagagcgaggaccagcccggcgaggaggaggacgacgagagaggcgccgacgccaccugggaccuggaccugcugcugaccaacuucagcggccccgagcccggcggcgccccccagaccugcgcccuggcccccagcgaggccagcggcgcccaguacccccccccccccgagacccugggcgccuacgccggcggccccggccugguggccggccugcugggcagcgaggaccacagcggcugggugagacccgcccugagagccagagcccccgacgccuucgugggccccgcccuggcccccgcccccgcccccgagcccaaggcccuggcccugcagcccguguaccccggccccggcgccggcagcagcggcggcuacuuccccagaaccggccugagcgugcccgccgccagcggcgcccccuacggccugcugagcggcuaccccgccauguaccccgccccccaguaccagggccacuuccagcuguucagaggccugcagggccccgcccccggccccgccaccagccccagcuuccugagcugccugggccccggcaccgugggcaccggccugggcggcaccgccgaggaccccggcgugaucgccgagaccgcccccagcaagagaggcagaagaagcugggccagaaagagacaggccgcccacaccugcgcccaccccggcugcggcaagagcuacaccaagagcagccaccugaaggcccaccugagaacccacaccggcgagaagcccuacgccugcaccugggagggcugcggcuggagauucgccagaagcgacgagcugaccagacacuacagaaagcacaccggccagagacccuucagaugccagcugugccccagagccuucagcagaagcgaccaccuggcccugcacaugaagagacaccuguga

SEQ ID NO: 9897 - RNA, 1089 nt, Artificial Sequence
  derived and/or modified sequence opt5 from Klf1__Homo_sapiens__AAB51173
auggccaccgcugagacagcccugcccagcaucuccacgcucaccgcgcugggcccuuucccggacacacaggaugacuuucuuaagugguggagaucugaagaggcucaagauauggggcccggaccucccgacccuaccgaacccccucugcacgugaaaagcgaggaucagccgggcgaagaggaggacgaugaacgcggggccgacgccacaugggaucucgaccugcuucugaccaacuucuccggacccgagccuggcggggcuccccagacaugcgcccucgcuccuucugaagccagcggagcgcaguaucccccgccucccgagacccugggcgccuacgcuggcgggccuggacuggucgccggccuccugggguccgaggaucauucuggauggguucggcccgcucuuagagcccgggcgcccgacgccuuugugggcccugcucuggccccggcucccgccccugaacccaaggcccucgcucugcaaccuguguaccccgggccgggagcgggcagcuccggcggguauuucccucgcacgggacuuagcguccccgccgcuucuggcgccccuuacgggcugcucuccggauaucccgccauguacccugcuccccaguaucagggccacuuucagcuguucagagggcugcaaggaccggccccuggccccgcgaccagccccucuuuucucuccugucugggcccugggacagugggaaccggccuugggggaacagcugaggauccgggcguuauugccgaaaccgcccccagcaaacgggggcgcagaucuugggcucggaagcgccaggccgcucauacgugcgcccacccuggcuguggaaaauccuacacaaagagcucccaucugaaggcgcaccucagaacccacacaggcgagaaacccuacgccugcaccugggaaggguguggauggcgguucgcucgcucugacgagcugaccagacauuaucggaagcacacaggccagcgcccuuuuagaugccagcuuuguccccgggccuucagcagauccgaccaucuggcucuccacaugaaacgccaccuguga

SEQ ID NO: 9898 - RNA, 1089 nt, Artificial Sequence
  derived and/or modified sequence opt6 from Klf1__Homo_sapiens__AAB51173
auggcaacagcagaaacagcacuaccaucuauuucaacacuuacagcauuagguccuuuuccagauacacaagacgauuuuuuaaaaugguggagaucagaagaagcucaagauaugggaccaggaccaccagauccaacagaaccuccucuacauguaaaaucagaagaucaacccggugaagaagaagaugacgaacguggagcagacgcaacuugggaucuugacuuauuauuaacuaauuuuucaggaccagaaccaggaggagcaccacaaacaugcgcauuagcaccaagcgaagcuucaggagcacaauauccuccaccuccagaaacacucggagcuuaugcuggugguccaggauuaguagccggucuauuagguucagaagaccauucugguuggguacgaccagcauuaagagcaagggcaccugaugcauuugucggaccagcuuuagcaccagcuccagcuccagaaccaaaagcacuagcauuacaaccagucuauccaggccccggagcaggauccuccggagguuacuuccccagaacuggauuaucaguacccgcugcaucaggagccccauacggauuauuaucaggauauccugcaauguauccagcaccacaauaucaaggucacuuccaauuauuuaggggacuucaaggaccugcucccggaccagcaacaucaccaucuuuuuuaucaugucuuggaccaggaacaguaggaacaggauuagguggaacagcagaagauccaggaguaauagcagaaacagcaccaucuaaaagaggaagaagaucaugggcacgaaaaagacaagcugcacauacaugcgcacauccaggauguggaaaaucauacacaaaaagcucacaucuaaaagcacacuugagaacacauacuggugaaaaaccauaugcauguacaugggaaggaugugguuggagauucgcaagaucugaugaauuaacuagacauuaccgaaaacauacaggucaaagaccauucagaugccaauuauguccaagagcuuuuuccagaucagaucauuuagcacuccauaugaaaagacauuuauaa

SEQ ID NO: 9899 - protein, 355 aa, Artificial Sequence
  Klf2__Homo_sapiens__Q9Y5W3
MALSEPILPSFSTFASPCRERGLQERWPRAEPESGGTDDDLNSVLDFILSMGLDGLGAEAAPEPPPPPPPPAFYYPEPGAPPPYSAPAGGLVSELLRPELDAPLGPALHGRFLLAPPGRLVKAEPPEADGGGGYGCAPGLTRGPRGLKREGAPGPAASCMRGPGGRPPPPPDTPPLSPDGPARLPAPGPRASFPPPFGGPGFGAPGPGLHYAPPAPPAFGLFDDAAAAAAALGLAPPAARGLLTPPASPLELLEAKPKRGRRSWPRKRTATHTCSYAGCGKTYTKSSHLKAHLRTHTGEKPYHCNWDGCGWKFARSDELTRHYRKHTGHRPFQCHLCDRAFSRSDHLALHMKRHM

SEQ ID NO: 9900 - RNA, 1068 nt, Artificial Sequence
  Klf2__Homo_sapiens__AAF13295
auggcgcugagugaacccauccugccguccuucuccacuuucgccagcccgugccgcgagcgcggccugcaggagcgcuggccgcgcgccgaacccgaguccggcggcaccgacgacgaccucaacagcgugcuggacuucauccuguccauggggcuggauggccugggcgccgaggccgccccggagccgccgccgccgcccccgccgccugcguucuauuaccccgaacccggcgcgcccccgcccuacagcgcccccgcggguggccuggugucugagcugcugcgacccgagcuggaugcgccgcuggggcccgcacugcacggccgcuuucugcuggcgccgcccggccgccuggucaaggccgagcccccugaagcggacggcggcggcggcuacggcugcgcccccgggcugacccguggaccgcgcggccucaagcgcgagggcgccccgggcccggcggcuucgugcaugcgaggucccgggggccgccccccgccgccgcccgacacaccgccgcucagccccgacggccccgcgcgccugcccgcgcccgguccgcgcgccuccuucccgccgccuuucgguggcccugguuucggcgcgcccgggcccggccugcauuacgcgccgccugcgcccccagccuucggucucuucgacgacgcggccgccgccgcggcagcccugggccuggcgccccccgccgcccgcggucuccucacgccgccugcguccccgcuggagcugcuggaggccaagccaaagcgcggccgccgcucuuggccccgcaaacgcaccgccacucacaccugcagcuacgcgggcugcggcaagaccuacaccaagaguucgcaucugaaggcgcaucugcgcacgcacacaggugagaagcccuaccacugcaacugggacggcugcggcuggaaguuugcgcgcucagacgagcucacgcgccacuaccgaaagcacacgggccaccggccauuccagugccaucugugcgaucgugccuuuucgcgcuccgaucaccuggcgcugcacaugaaacggcacauguag

SEQ ID NO: 9901 - RNA, 1068 nt, Artificial Sequence
  derived and/or modified sequence opt1 from Klf2__Homo_sapiens__AAF13295
auggcccugagcgagcccauccucccguccuucagcaccuucgccucccccugccgcgagcggggccugcaggagcgcuggccccgggcggagcccgagagcgggggcaccgacgacgaccugaacuccgugcucgacuucauccugagcauggggcuggacggccucggggccgaggccgccccggagcccccccccccgcccccccccccggccuucuacuaccccgagcccggcgcgcccccgcccuacuccgcccccgccggcgggcuggucagcgagcugcuccgccccgagcuggacgccccgcugggccccgcgcuccacgggcgguuccugcuggccccccccggccgccucgugaaggccgagccgcccgaggccgacgggggcggcggguacggcugcgcccccgggcugacgcggggcccccgcggccugaagcgggagggggcgccgggccccgccgccuccugcaugcgcgggcccggcgggcggccgcccccccccccggacacccccccccucagccccgacggcccggcccgccugcccgcccccggcccccgggcguccuucccgccccccuucgggggccccggguucggcgccccggggcccggccugcacuacgccccccccgccccgcccgccuucggccucuucgacgacgcggccgccgccgccgcggcccuggggcuggccccccccgccgcgcgcggccuccugaccccgcccgccagcccccuggagcuccuggaggccaagccgaagcgggggcgccgguccuggccccgcaagcggaccgccacgcacaccugcagcuacgccggcugcgggaagaccuacaccaaguccagccaccugaaggcgcaccuccgcacgcacaccggcgagaagcccuaccacugcaacugggacggcugcggguggaaguucgcccgguccgacgagcugacccgccacuaccgcaagcacaccggccaccggcccuuccagugccaccugugcgaccgcgccuucagccgguccgaccaccucgcccugcacaugaagcgccacauguga

SEQ ID NO: 9902 - RNA, 1068 nt, Artificial Sequence
  derived and/or modified sequence opt2 from Klf2__Homo_sapiens__AAF13295
auggcccucuccgagcccauccuccccuccuucuccaccuucgccucccccugccgcgagcgcggccuccaggagcgcuggccccgcgccgagcccgaguccggcggcaccgacgacgaccucaacuccguccucgacuucauccucuccaugggccucgacggccucggcgccgaggccgcccccgagccccccccccccccccccccccccgccuucuacuaccccgagcccggcgcccccccccccuacuccgcccccgccggcggccucgucuccgagcuccuccgccccgagcucgacgccccccucggccccgcccuccacggccgcuuccuccucgccccccccggccgccucgucaaggccgagccccccgaggccgacggcggcggcggcuacggcugcgcccccggccucacccgcggcccccgcggccucaagcgcgagggcgcccccggccccgccgccuccugcaugcgcggccccggcggccgccccccccccccccccgacacccccccccucucccccgacggccccgcccgccuccccgcccccggcccccgcgccuccuuccccccccccuucggcggccccggcuucggcgcccccggccccggccuccacuacgccccccccgccccccccgccuucggccucuucgacgacgccgccgccgccgccgccgcccucggccucgccccccccgccgcccgcggccuccucaccccccccgccuccccccucgagcuccucgaggccaagcccaagcgcggccgccgcuccuggccccgcaagcgcaccgccacccacaccugcuccuacgccggcugcggcaagaccuacaccaaguccucccaccucaaggcccaccuccgcacccacaccggcgagaagcccuaccacugcaacugggacggcugcggcuggaaguucgcccgcuccgacgagcucacccgccacuaccgcaagcacaccggccaccgccccuuccagugccaccucugcgaccgcgccuucucccgcuccgaccaccucgcccuccacaugaagcgccacauguga

SEQ ID NO: 9903 - RNA, 1068 nt, Artificial Sequence
  derived and/or modified sequence opt3 from Klf2__Homo_sapiens__AAF13295
auggcccugagcgagcccauccucccuuccuucucuaccuuugcuucaccaugcagagaaaggggccuucaggagcgguggccgcgcgcagaacccgagagugggggaacagacgaugaccugaacagcguguuggauuucauuuuauccaugggucuggacggccuaggggccgaagcggcuccugagccacccccuccacccccuccaccggccuuuuacuaucccgagccuggagcaccacccccuuacucugccccagcuggcggucucgucucggaacugcuucgacccgagcuggaugcaccguuggggccugcccuccacggacguuuccugcuggcucccccaggcagacucguuaaggccgaaccucccgaggcggacggcgggggagguuauggcugugcaccaggguuaacuaggggaccccggggccugaaacgcgagggugccccugggccagcugccucaugcaugagaggaccgggcggcaggcccccuccacccccugauacgccaccccuuagcccggacgggccugcacgguugccagcucccggaccucgcgccaguuuucccccaccuuucgguggccccggguuuggagcgccaggcccgggucugcauuacgccccucccgcaccacccgcuuucgggcuauuugaugacgccgcugccgcagccgcugcgcucggccuggcaccuccagccgcucgaggacuucugacacccccugccuccccguuggaacuccuggaggcaaagccaaaaagaggcaggcggucuuggccccguaagcgcaccgccacucacaccuguagcuaugcugggugcggaaaaacauacaccaaguccucacauuuaaaggcccaccugagaacucauacaggugaaaaaccuuaucacuguaauugggauggcugcggguggaaguucgcaaggagugacgagcucacccggcacuaccgaaaacauacgggacaccgcccauuucaaugucaucuuugcgauagagcguucagcaggucugaccaccuggcuuugcacaugaagcggcauauguga

SEQ ID NO: 9904 - RNA, 1068 nt, Artificial Sequence
  derived and/or modified sequence opt4 from Klf2__Homo_sapiens__AAF13295
auggcccugagcgagcccauccugcccagcuucagcaccuucgccagccccugcagagagagaggccugcaggagagauggcccagagccgagcccgagagcggcggcaccgacgacgaccugaacagcgugcuggacuucauccugagcaugggccuggacggccugggcgccgaggccgcccccgagccccccccccccccccccccccccgccuucuacuaccccgagcccggcgcccccccccccuacagcgcccccgccggcggccuggugagcgagcugcugagacccgagcuggacgccccccugggccccgcccugcacggcagauuccugcuggccccccccggcagacuggugaaggccgagccccccgaggccgacggcggcggcggcuacggcugcgcccccggccugaccagaggccccagaggccugaagagagagggcgcccccggccccgccgccagcugcaugagaggccccggcggcagacccccccccccccccgacacccccccccugagccccgacggccccgccagacugcccgcccccggccccagagccagcuuccccccccccuucggcggccccggcuucggcgcccccggccccggccugcacuacgccccccccgccccccccgccuucggccuguucgacgacgccgccgccgccgccgccgcccugggccuggccccccccgccgccagaggccugcugaccccccccgccagcccccuggagcugcuggaggccaagcccaagagaggcagaagaagcuggcccagaaagagaaccgccacccacaccugcagcuacgccggcugcggcaagaccuacaccaagagcagccaccugaaggcccaccugagaacccacaccggcgagaagcccuaccacugcaacugggacggcugcggcuggaaguucgccagaagcgacgagcugaccagacacuacagaaagcacaccggccacagacccuuccagugccaccugugcgacagagccuucagcagaagcgaccaccuggcccugcacaugaagagacacauguga

SEQ ID NO: 9905 - RNA, 1068 nt, Artificial Sequence
  derived and/or modified sequence opt5 from Klf2__Homo_sapiens__AAF13295
auggcccugagcgagcccauccucccuuccuucucuaccuuugcuagcccgugcagagaacggggccugcaggagcgcuggcccagagccgaaccugaguccgggggaacagacgaugaccuuaacucugugcuggauuucauucucagcaugggccuggacgggcuuggagcggaagcugcccccgagccucccccuccgcccccucccccugccuuuuacuaucccgagccgggcgcuccucccccuuacuccgcccccgcugggggacuggucucugaacuccugcggcccgagcuggaugccccucucggcccggcgcugcacggccgcuuccuucuggcucccccugggagacucguuaaggccgaacccccugaggccgacggaggcgggggauauggcugugcucccgggcugacgcggggaccgcgcggccuuaaaagagagggcgccccugggcccgcggccagcugcaugcggggaccuggcgggagacccccucccccgccugauaccccuccccugucccccgacggaccggcucgccuccccgccccuggcccccgggcuagcuuuccucccccuuucgggggacccggcuuuggcgccccggggccuggacugcauuacgccccucccgcucccccggcguucggccuguuugaugacgccgcugccgccgcugccgcgcucgggcuggcuccucccgccgcccgcggacuucugacaccucccgcuucuccccucgaacugcuugaggccaagccuaaaagaggccggcgcuccuggccgagaaagcggaccgcuacacacaccuguagcuaugccgggugcggcaaaacauacaccaagucuucccaucugaaggcgcaccucagaacgcauaccggagaaaaacccuaucacuguaauugggauggcugcggguggaaguucgcccgcagcgacgagcugacacggcacuacagaaaacauaccggacaccgcccuuuucaaugucaucugugcgaucgggcuuucucuagauccgaccaccucgcccugcacaugaagcgccauauguga

SEQ ID NO: 9906 - RNA, 1068 nt, Artificial Sequence
  derived and/or modified sequence opt6 from Klf2__Homo_sapiens__AAF13295
auggcucuaagugaaccaauauuaccaaguuuuucuacauuugcaucaccauguagagaaagaggacuacaagaaagauggccaagagcagaaccagaaucaggaggaacagaugaugaucuaaauucuguauuagacuuuauauuaucuaugggauuagauggauuaggagcagaagcagcaccagaacccccaccaccaccaccuccaccagcuuuuuacuacccagaaccuggugcuccaccaccauauagugcaccagcaggcggauuaguauccgaauuauuaagaccagaacuugacgcuccauuaggaccagcauuacauggaagauuuuuacuagcaccaccaggaagauuaguaaaagcagaaccaccugaagcagaugguggaggaggauauggaugugcaccaggacuaacaagaggaccaagaggauuaaaaagagaaggagcaccaggaccugcagcaucaugcaugagaggaccaggagguagaccaccaccaccaccagauacaccaccauuaagcccagauggaccugcaagauuaccugcaccuggacccagagcuucauuuccaccuccauuuggaggaccaggauuuggagcaccugguccaggacuacauuaugcuccaccagcacccccagcauuuggacuuuuugacgaugccgcugcagcagcagcugcauuaggacuagcaccaccagcagcaagagguuuacuaacacccccagcaagcccauuagaauuacuugaagcaaaaccaaaaagagguagaagaucauggccaagaaaaagaacugcaacacauacauguaguuaugcaggcugugguaaaacauauacaaaaaguucucacuuaaaagcacauuuaagaacacauacuggagaaaaaccauaucacuguaauugggacggaugcgguuggaaauuugcuagaucagaugaacuaacaagacauuaucgaaaacauacaggacauagaccauuccaaugucauuuaugugauagagccuuuucuagaucugaucauuuagcacuucauaugaaaagacauauguaa

SEQ ID NO: 9907 - protein, 145 aa, Artificial Sequence [sequence omitted]

SEQ ID NO: 9908 - RNA, 438 nt, Artificial Sequence
  Klf4__Homo_sapiens__ADL14248
auggcugucagcgacgcgcugcucccaucuuucuccacguucgcgucuggcccggcgggaagggagaagacacugcgucaagcaggugccccgaauaaccucaugccacccgguuccugcaugccagaggagcccaagccaaagaggggaagacgaucguggccccggaaaaggaccgccacccacacuugugauuacgcgggcugcggcaaaaccuacacaaagaguucccaucucaaggcacaccugcgaacccacacaggugagaaaccuuaccacugugacugggacggcuguggauggaaauucgcccgcucagaugaacugaccuggcacuaccguaaacacacggggcaccgcccguuccagugccaaaaaugcgaccgagcauuuuccaggucggaccaccucgccuuacacaugaagaggcauuuuuaa

SEQ ID NO: 9909 - RNA, 438 nt, Artificial Sequence
  derived and/or modified sequence opt1 from Klf4__Homo_sapiens__ADL14248
auggccgugagcgacgcccugcuccccuccuucagcaccuucgcguccggcccggccgggcgcgagaagacccugcggcaggccggcgcccccaacaaccugaugccgcccgggagcugcaugcccgaggagcccaagcccaagcgcggccggcgcuccuggccccggaagcgcacggccacccacacgugcgacuacgcggggugcggcaagaccuacaccaagagcucccaccucaaggcccaccuccggacccacaccggcgagaagccguaccacugcgacugggacgggugcggcuggaaguucgcccgcagcgacgagcugaccuggcacuaccggaagcacacggggcaccgccccuuccagugccagaagugcgaccgggccuucucccgcagcgaccaccuggcgcugcacaugaagcggcacuucuga

SEQ ID NO: 9910 - RNA, 438 nt, Artificial Sequence
  derived and/or modified sequence opt2 from Klf4__Homo_sapiens__ADL14248
auggccgucuccgacgcccuccuccccuccuucuccaccuucgccuccggccccgccggccgcgagaagacccuccgccaggccggcgcccccaacaaccucaugccccccggcuccugcaugcccgaggagcccaagcccaagcgcggccgccgcuccuggccccgcaagcgcaccgccacccacaccugcgacuacgccggcugcggcaagaccuacaccaaguccucccaccucaaggcccaccuccgcacccacaccggcgagaagcccuaccacugcgacugggacggcugcggcuggaaguucgcccgcuccgacgagcucaccuggcacuaccgcaagcacaccggccaccgccccuuccagugccagaagugcgaccgcgccuucucccgcuccgaccaccucgcccuccacaugaagcgccacuucuga

SEQ ID NO: 9911 - RNA, 438 nt, Artificial Sequence
  derived and/or modified sequence opt3 from Klf4__Homo_sapiens__ADL14248
auggccgugagcgacgcucugcuccccuccuucucuaccuuugcaucaggcccugccgggagagagaagacacuuaggcaggcgggagcuccaaacaaucugaugccgcccgguaguugcaugccugaggaaccaaaacccaagcggggccgccgaagcuggccucguaaaagaacugccacgcacaccugugauuacgcagggugcggaaagacauauacuaaauccucucauuugaaggcccacuuaaggacccauacaggcgaaaagccauaccacugugacugggaugguugcggguggaaauucgcucggucggacgagcugaccuggcauuaucgcaagcacacuggacacagacccuuucaaugucagaaaugcgauagggcauucucacggagcgaccaucuagcccuccacaugaagcgccauuuuuga

SEQ ID NO: 9912 - RNA, 438 nt, Artificial Sequence
  derived and/or modified sequence opt4 from Klf4__Homo_sapiens__ADL14248
auggccgugagcgacgcccugcugcccagcuucagcaccuucgccagcggccccgccggcagagagaagacccugagacaggccggcgcccccaacaaccugaugccccccggcagcugcaugcccgaggagcccaagcccaagagaggcagaagaagcuggcccagaaagagaaccgccacccacaccugcgacuacgccggcugcggcaagaccuacaccaagagcagccaccugaaggcccaccugagaacccacaccggcgagaagcccuaccacugcgacugggacggcugcggcuggaaguucgccagaagcgacgagcugaccuggcacuacagaaagcacaccggccacagacccuuccagugccagaagugcgacagagccuucagcagaagcgaccaccuggcccugcacaugaagagacacuucuga

SEQ ID NO: 9913 - RNA, 438 nt, Artificial Sequence
  derived and/or modified sequence opt5 from Klf4__Homo_sapiens__ADL14248
auggccgugagcgacgcucugcuccccuccuucucuaccuuugccagcggcccugcggggagagagaagacacugcggcaggcuggagccccgaacaaucuuaugcccccuggcuccugcaugcccgaggaaccuaaacccaagcgcgggagacggucuuggccucgcaaaagaacggccacccacacaugugauuacgcuggaugcggcaagaccuauacaaaaagcucccaucugaaggcccaccuccggacccauacaggggaaaagccguaccacugugacugggauggaugcggcuggaaauucgcucgcucugacgagcugaccuggcauuauagaaagcacacgggccaccggcccuuucaaugucagaaaugcgaucgcgccuucagcagauccgaccaucuugcgcugcacaugaagcggcauuuuuga

SEQ ID NO: 9914 - RNA, 438 nt, Artificial Sequence
  derived and/or modified sequence opt6 from Klf4__Homo_sapiens__ADL14248
auggcaguaagcgaugcauuacuaccaucauuuagcacauucgcaagcggaccagcaggaagagaaaaaacauuaagacaagcaggagcaccaaacaacuuaaugccaccaggaucaugcaugccagaagaaccaaaaccaaaaagaggaagaagaucauggccaagaaaaagaacagcaacacacacaugugauuacgcaggaugcggaaaaacauacacaaaaagcucacacuuaaaagcacacuuaagaacacacacaggagaaaaaccauaccauugcgauugggauggauguggauggaaauuugcaagaagcgaugaauuaacauggcacuauagaaaacacacaggacacagaccauuccaaugccaaaaaugugacagagcauuuagcagaagcgaucacuuagcauuacacaugaaaagacacuuuuaa

SEQ ID NO: 9915 - protein, 111 aa, Artificial Sequence
  Klf4__Homo_sapiens__L0R3V2
MPPGSCMPEEPKPKRGRRSWPRKRTATHTCDYAGCGKTYTKSSHLKAHLRTHTGEKPYHCDWDGCGWKFARSDELTRHYRKHTGHRPFQCQKCDRAFSRSDHLALHMKRHF

SEQ ID NO: 9916 - RNA, 336 nt, Artificial Sequence
  Klf4__Homo_sapiens__CCO02799
augccacccgguuccugcaugccagaggagcccaagccaaagaggggaagacgaucguggccccggaaaaggaccgccacccacacuugugauuacgcgggcugcggcaaaaccuacacaaagaguucccaucucaaggcacaccugcgaacccacacaggugagaaaccuuaccacugugacugggacggcuguggauggaaauucgcccgcucagaugaacugaccaggcacuaccguaaacacacggggcaccgcccguuccagugccaaaaaugcgaccgagcauuuuccaggucggaccaccucgccuuacacaugaagaggcauuuuuaa

SEQ ID NO: 9917 - RNA, 336 nt, Artificial Sequence
  derived and/or modified sequence opt1 from Klf4__Homo_sapiens__CCO02799
augcccccgggcagcugcaugcccgaggagcccaagcccaagcgcgggcggcgcuccuggccgcggaagcgcaccgccacccacacgugcgacuacgccggcugcgggaagaccuacaccaagagcucccaccugaaggcgcaccuccggacccacacgggcgagaagcccuaccacugcgacugggacgggugcggcuggaaguucgcccgcagcgacgagcugacccggcacuaccgcaagcacaccggccaccggcccuuccagugccagaagugcgaccgcgccuucucccggagcgaccaccuggcccuccacaugaagcgccacuucuga

SEQ ID NO: 9918 - RNA, 336 nt, Artificial Sequence
  derived and/or modified sequence opt2 from Klf4__Homo_sapiens__CCO02799
augccccccggcuccugcaugcccgaggagcccaagcccaagcgcggccgccgcuccuggccccgcaagcgcaccgccacccacaccugcgacuacgccggcugcggcaagaccuacaccaaguccucccaccucaaggcccaccuccgcacccacaccggcgagaagcccuaccacugcgacugggacggcugcggcuggaaguucgcccgcuccgacgagcucacccgccacuaccgcaagcacaccggccaccgccccuuccagugccagaagugcgaccgcgccuucucccgcuccgaccaccucgcccuccacaugaagcgccacuucuga

SEQ ID NO: 9919 - RNA, 336 nt, Artificial Sequence
  derived and/or modified sequence opt3 from Klf4__Homo_sapiens__CCO02799
augcccccuggcagcugcaugccagaggaaccgaagcccaaaagagggaggcgguccuggccucgcaagcgaaccgccacacacacuugugacuacgcuggaugcgguaaaacguauaccaagucuucacaucugaaagcacaccuccguacacauacuggcgagaagccauaccacugugauugggacgggugcggauggaaguucgccagaagugaugaacuuaccaggcauuaucggaaacacacaggccaccgccccuuucagugucaaaagugcgacagagcguucagcagguccgaucaucuggcuuugcacaugaaacggcauuuuuga

SEQ ID NO: 9920 - RNA, 336 nt, Artificial Sequence
  derived and/or modified sequence opt4 from Klf4__Homo_sapiens__CCO02799
augccccccggcagcugcaugcccgaggagcccaagcccaagagaggcagaagaagcuggcccagaaagagaaccgccacccacaccugcgacuacgccggcugcggcaagaccuacaccaagagcagccaccugaaggcccaccugagaacccacaccggcgagaagcccuaccacugcgacugggacggcugcggcuggaaguucgccagaagcgacgagcugaccagacacuacagaaagcacaccggccacagacccuuccagugccagaagugcgacagagccuucagcagaagcgaccaccuggcccugcacaugaagagacacuucuga

SEQ ID NO: 9921 - RNA, 336 nt, Artificial Sequence
  derived and/or modified sequence opt5 from Klf4__Homo_sapiens__CCO02799
augcccccuggcagcugcaugccggaggaacccaagccuaaaagagggcggcgcuccuggcccagaaagcggaccgccacacacacgugugacuacgcuggaugcggcaaaaccuauacaaagucuagccaucugaaagcccaccuccgcacccauacaggggagaagccuuaccacugugauugggacggaugcggcuggaaguucgcgagauccgaugaacugacccggcauuaucgcaaacacacagggcacagacccuuucagugucaaaagugcgaccgggcuuucucucgcagcgaucaucuugcccugcacaugaaaagacauuuuuga

SEQ ID NO: 9922 - RNA, 336 nt, Artificial Sequence
  derived and/or modified sequence opt6 from Klf4__Homo_sapiens__CCO02799
augccaccaggaucaugcaugccagaagaaccaaaaccaaaaagaggaagaagaucauggccaagaaaaagaacagcaacacacacaugcgacuacgcaggaugcggaaaaacauacacaaaaucaucacaccuaaaagcacaccuaagaacacacacaggagaaaaaccauaccacugcgacugggacggaugcggauggaaauucgcaagaucagacgaacuaacaagacacuacagaaaacacacaggacacagaccauuccaaugccaaaaaugcgacagagcauucucaagaucagaccaccuagcacuacacaugaaaagacacuucuaa

SEQ ID NO: 9923 - protein, 74 aa, Artificial Sequence
  Klf5__Homo_sapiens__A0A0A0N0L4
MATRVLSMSARLGPVPQPPAPQDEPVFAQLKPVLGAANPARDAALFPGEELKHAHHRPQAQPAAASRGPGPDKM

SEQ ID NO: 9924 - RNA, 225 nt, Artificial Sequence
  Klf5__Homo_sapiens__AER93390
auggcuacaagggugcugagcaugagcgcccgccugggacccgugccccagccgccggcgccgcaggacgagccgguguucgcgcagcucaagccggugcugggcgccgcgaauccggcccgcgacgcggcgcucuuccccggcgaggagcugaagcacgcgcaccaccgcccgcaggcgcagcccgcggcugccuccagaggaccugguccagacaagauguga

SEQ ID NO: 9925 - RNA, 225 nt, Artificial Sequence
  derived and/or modified sequence opt1 from Klf5__Homo_sapiens__AER93390
auggccacccgcgugcugagcauguccgcccggcucggccccgucccgcagccgcccgcgccccaggacgagcccguguucgcccagcugaagcccgugcugggggccgccaaccccgcccgcgacgcggcccucuuccccggcgaggagcugaagcacgcccaccaccggccgcaggcccagcccgcggccgccagccgcgggcccggccccgacaagauguga

SEQ ID NO: 9926 - RNA, 225 nt, Artificial Sequence
  derived and/or modified sequence opt2 from Klf5__Homo_sapiens__AER93390
auggccacccgcguccucuccauguccgcccgccucggccccgucccccagccccccgccccccaggacgagcccgucuucgcccagcucaagcccguccucggcgccgccaaccccgcccgcgacgccgcccucuuccccggcgaggagcucaagcacgcccaccaccgcccccaggcccagcccgccgccgccucccgcggccccggccccgacaagauguga

SEQ ID NO: 9927 - RNA, 225 nt, Artificial Sequence
  derived and/or modified sequence opt3 from Klf5__Homo_sapiens__AER93390
auggccaccagagugcugagcauguccgcuaggcucggccccgucccucagccaccggcaccccaagacgagccuguuuucgcccagcuuaagccagugcugggggcggcuaaccccgcccgggaugcagccuuguuuccuggagaagaguuaaaacacgcucaucaccgcccacaggcacagcccgccgcugccucucgagguccuggcccagacaagauguga

SEQ ID NO: 9928 - RNA, 225 nt, Artificial Sequence
  derived and/or modified sequence opt4 from Klf5__Homo_sapiens__AER93390
auggccaccagagugcugagcaugagcgccagacugggccccgugccccagccccccgccccccaggacgagcccguguucgcccagcugaagcccgugcugggcgccgccaaccccgccagagacgccgcccuguuccccggcgaggagcugaagcacgcccaccacagaccccaggcccagcccgccgccgccagcagaggccccggccccgacaagauguga

SEQ ID NO: 9929 - RNA, 225 nt, Artificial Sequence
  derived and/or modified sequence opt5 from Klf5__Homo_sapiens__AER93390
auggccaccagagugcugagcauguccgcucggcucggccccgucccucagccgcccgccccucaagacgagcccguuuucgcgcagcugaagccugugcuuggggcugccaaccccgcccgcgaugcugcccuguuuccuggagaggaacucaaacacgcucaucacagaccgcaggcccagcccgcggccgcuucucggggcccugggcccgacaagauguga

SEQ ID NO: 9930 - RNA, 225 nt, Artificial Sequence
  derived and/or modified sequence opt6 from Klf5__Homo_sapiens__AER93390
auggcaacaagaguauuaagcaugagcgcaagauuaggaccaguaccacaaccaccagcaccacaagacgaaccaguauucgcacaauuaaaaccaguauuaggagcagcaaauccagcaagagaugcagcacuauuuccaggagaagaauuaaaacacgcacaccauagaccacaagcacaaccagcagcagcaucaagaggaccaggaccagauaaaauguaa

SEQ ID NO: 9931 - protein, 26 aa, Artificial Sequence
  Klf5__Homo_sapiens__A0A0A0N0L7
MATRVLSMSARLGPAAASRGPGPDKM

SEQ ID NO: 9932 - RNA, 81 nt, Artificial Sequence
  Klf5__Homo_sapiens__AER93389
auggcuacaagggugcugagcaugagcgcccgccugggacccgcggcugccuccagaggaccugguccagacaagauguga

SEQ ID NO: 9933 - RNA, 81 nt, Artificial Sequence
  derived and/or modified sequence opt1 from Klf5__Homo_sapiens__AER93389
auggccacccgcgugcugagcauguccgcccggcucggccccgcggccgccagccgcgggccgggccccgacaagauguga

SEQ ID NO: 9934 - RNA, 81 nt, Artificial Sequence
  derived and/or modified sequence opt2 from Klf5__Homo_sapiens__AER93389
auggccacccgcguccucuccauguccgcccgccucggccccgccgccgccucccgcggccccggccccgacaagauguga

SEQ ID NO: 9935 - RNA, 81 nt, Artificial Sequence
  derived and/or modified sequence opt3 from Klf5__Homo_sapiens__AER93389
auggccaccagagugcugagcauguccgcuaggcucggccccgcagccgcgucucgggggccuggaccagacaagauguga

SEQ ID NO: 9936 - RNA, 81 nt, Artificial Sequence
  derived and/or modified sequence opt4 from Klf5__Homo_sapiens__AER93389
auggccaccagagugcugagcaugagcgccagacugggccccgccgccgccagcagaggccccggccccgacaagauguga

SEQ ID NO: 9937 - RNA, 81 nt, Artificial Sequence
  derived and/or modified sequence opt5 from Klf5__Homo_sapiens__AER93389
auggccaccagagugcugagcauguccgcucggcucggccccgccgcggcuucucgcgggccuggaccggacaagauguga

SEQ ID NO: 9938 - RNA, 81 nt, Artificial Sequence
  derived and/or modified sequence opt6 from Klf5__Homo_sapiens__AER93389
auggcaacaagaguauuaagcaugagcgcaagauuaggaccagcagcagcaucaagaggaccaggaccagauaaaauguaa

SEQ ID NO: 9939 - protein, 450 aa, Artificial Sequence
  Klf5__Homo_sapiens__A0A0A0N0M4
MATRVLSMSARLGPVPQPPAPQDEPVFAQLKPVLGAANPARDAALFPGEELKHAHHRPQAPQPAQPPATGPRLPPEDLVQTRCEMEKYLTPQLPPVPIIPEHKKYRRDSASVVDQFFTDTEGLPYSINMNVFLPDITHLRTGLYKSQRPCVTHIKTEPVAIFSHQSETTAPPPAPTQALPEFTSIFSSHQTAAPEVNNIFIKQELPTPDLHLSVPTQQGHLYQLLNTPDLDMPSSTNQTAAMDTLNVSMSAAMAGLNTHTSAVPQTAVKQFQGMPPCTYTMPSQFLPQQATYFPPSPPSSEPGSPDRQAEMLQNLTPPPSYAATIASKLAIHNPNLPTTLPVNSQNIQPVRYNRRSNPDLEKRRIHYCDYPGCTKVYTKSSHLKAHLRTHTGEKPYKCTWEGCDWRFARSDELTRHYRKHTGAKPFQCGVCNRSFSRSDHLALHMKRHQN

SEQ ID NO: 9940 - RNA, 1353 nt, Artificial Sequence
  Klf5__Homo_sapiens__AER93391
auggcuacaagggugcugagcaugagcgcccgccugggacccgugccccagccgccggcgccgcaggacgagccgguguucgcgcagcucaagccggugcugggcgccgcgaauccggcccgcgacgcggcgcucuuccccggcgaggagcugaagcacgcgcaccaccgcccgcaggccccgcagccggcccagccgcccgccaccggcccgcggcugccuccagaggaccugguccagacaagaugugaaauggagaaguaucugacaccucagcuuccuccaguuccuauaauuccagagcauaaaaaguauagacgagacagugccucagucguagaccaguucuucacugacacugaaggguuaccuuacaguaucaacaugaacgucuuccucccugacaucacucaccugagaacuggccucuacaaaucccagagaccgugcguaacacacaucaagacagaaccuguugccauuuucagccaccagagugaaacgacugccccuccuccggccccgacccaggcccucccugaguucaccaguauauucagcucacaccagaccgcagcuccagaggugaacaauauuuucaucaaacaagaacuuccuacaccagaucuucaucuuucugucccuacccagcagggccaccuguaccagcuacugaauacaccggaucuagauaugcccaguucuacaaaucagacagcagcaauggacacucuuaauguuucuaugucagcugccauggcaggccuuaacacacacaccucugcuguuccgcagacugcagugaaacaauuccagggcaugcccccuugcacauacacaaugccaagucaguuucuuccacaacaggccacuuacuuucccccgucaccaccaagcucagagccuggaaguccagauagacaagcagagaugcuccagaauuuaaccccaccuccauccuaugcugcuacaauugcuucuaaacuggcaauucacaauccaaauuuacccaccacccugccaguuaacucacaaaacauccaaccugucagauacaauagaaggaguaaccccgauuuggagaaacgacgcauccacuacugcgauuacccugguugcacaaaaguuuauaccaagucuucucauuuaaaagcucaccugaggacucacacuggugaaaagccauacaaguguaccugggaaggcugcgacuggagguucgcgcgaucggaugagcugacccgccacuaccggaagcacacaggcgccaagcccuuccagugcggggugugcaaccgcagcuucucgcgcucugaccaccuggcccugcauaugaagaggcaccagaacuga

SEQ ID NO: 9941 - RNA, 1353 nt, Artificial Sequence
  derived and/or modified sequence opt1 from Klf5__Homo_sapiens__AER93391
auggccacccgcgugcugagcauguccgcccggcucggccccgucccgcagccgcccgcgccccaggacgagcccguguucgcccagcugaagcccgugcugggggccgccaaccccgcccgcgacgcggcccucuuccccggcgaggagcugaagcacgcccaccaccggccgcaggcgccccagcccgcccagcccccggccaccgggccccgccugccgcccgaggaccucguccagacgcggugcgagauggagaaguaccugacgccccagcugccgcccgugcccaucauccccgagcacaagaaguaccgccgggacagcgccuccguggucgaccaguucuucaccgacaccgagggccuccccuacagcaucaacaugaacguguuccugcccgacaucacccaccuccgcaccgggcuguacaagucccagcggcccugcgugacccacaucaagaccgagccggucgccaucuucagccaccaguccgagacgaccgccccgccgcccgcgcccacccaggcccugcccgaguucaccagcaucuucuccagccaccagacggccgcccccgaggugaacaacaucuucaucaagcaggagcugcccacccccgaccuccaccuguccgugcccacccagcagggccaccuguaccagcuccugaacacccccgaccuggacaugccgagcuccacgaaccagaccgccgcgauggacacccucaacgucagcauguccgccgccauggccggccugaacacccacacgagcgccgugccccagaccgcggugaagcaguuccaggggaugccgcccugcaccuacaccaugcccucccaguuccugccccagcaggccacguacuucccgcccagcccgcccuccagcgagcccggcagccccgaccgccaggccgagaugcuccagaaccugacgcccccgcccuccuacgccgccaccaucgcgagcaagcuggccauccacaaccccaaccuccccaccacccugcccgucaacucccagaacauccagcccgugcgguacaaccgccggagcaaccccgaccuggagaagcgccggauccacuacugcgacuacccggggugcaccaagguguacaccaaguccagccaccucaaggcccaccuccgcacccacacgggcgagaagcccuacaagugcaccugggaggggugcgacuggcgguucgcccgcuccgacgagcugacccggcacuaccgcaagcacaccggcgcgaagcccuuccagugcggcgucugcaaccggagcuucucccgcagcgaccaccuggcccugcacaugaagcgccaccagaacuga

SEQ ID NO: 9942 - RNA, 1353 nt, Artificial Sequence
  derived and/or modified sequence opt2 from Klf5__Homo_sapiens__AER93391
auggccacccgcguccucuccauguccgcccgccucggccccgucccccagccccccgccccccaggacgagcccgucuucgcccagcucaagcccguccucggcgccgccaaccccgcccgcgacgccgcccucuuccccggcgaggagcucaagcacgcccaccaccgcccccaggccccccagcccgcccagccccccgccaccggcccccgccucccccccgaggaccucguccagacccgcugcgagauggagaaguaccucaccccccagcucccccccguccccaucauccccgagcacaagaaguaccgccgcgacuccgccuccgucgucgaccaguucuucaccgacaccgagggccuccccuacuccaucaacaugaacgucuuccuccccgacaucacccaccuccgcaccggccucuacaagucccagcgccccugcgucacccacaucaagaccgagcccgucgccaucuucucccaccaguccgagaccaccgcccccccccccgcccccacccaggcccuccccgaguucaccuccaucuucuccucccaccagaccgccgcccccgaggucaacaacaucuucaucaagcaggagcuccccacccccgaccuccaccucuccguccccacccagcagggccaccucuaccagcuccucaacacccccgaccucgacaugcccuccuccaccaaccagaccgccgccauggacacccucaacgucuccauguccgccgccauggccggccucaacacccacaccuccgccgucccccagaccgccgucaagcaguuccagggcaugccccccugcaccuacaccaugcccucccaguuccucccccagcaggccaccuacuucccccccuccccccccuccuccgagcccggcucccccgaccgccaggccgagaugcuccagaaccucacccccccccccuccuacgccgccaccaucgccuccaagcucgccauccacaaccccaaccuccccaccacccuccccgucaacucccagaacauccagcccguccgcuacaaccgccgcuccaaccccgaccucgagaagcgccgcauccacuacugcgacuaccccggcugcaccaaggucuacaccaaguccucccaccucaaggcccaccuccgcacccacaccggcgagaagcccuacaagugcaccugggagggcugcgacuggcgcuucgcccgcuccgacgagcucacccgccacuaccgcaagcacaccggcgccaagcccuuccagugcggcgucugcaaccgcuccuucucccgcuccgaccaccucgcccuccacaugaagcgccaccagaacuga

SEQ ID NO: 9943 - RNA, 1353 nt, Artificial Sequence
  derived and/or modified sequence opt3 from Klf5__Homo_sapiens__AER93391
auggccaccagagugcugagcauguccgcuaggcucggccccgucccucagccaccggcaccccaagacgagccuguuuucgcccagcuuaagccagugcugggggcggcuaaccccgcccgggaugcagccuuguuuccuggagaagaguuaaaacacgcucaucaccgcccacaggcaccccagccugcccaaccaccggcuacagguccccgacugccuccagaagaccuaguacagacucguugcgagauggaaaaguaccucacgccccagcugccuccagugcccaucauuccggagcauaaaaaguauagaagggauucugccucagucguggaccaguucuuuaccgauacagagggccuuccuuacaguauaaauaugaacguuuuccugcccgacaucacucacuugcggaccgggcucuauaaaagccaacgcccaugugugacacauauuaagaccgaaccugucgcgaucuuuucccaccagucugagacuacagcacccccacccgccccuacccaggcucugccagaguucacgucgauuuuuagcagccaccagacugccgcaccggaagugaauaacaucuucauaaagcaagagcugcccaccccugaucuccauuuaaguguaccaacacagcagggacaccuguaccaacuuuugaauacucccgaccuggauaugccuuccucuaccaaccagacagcugccauggacacccuaaauguuagcauguccgcggccauggcaggccucaacacgcauacuucagcugugccacagacagccgucaaacaguuucaagguaugcccccgugcaccuauacuaugccuagucaguuccugccacagcaggcuacauacuuucccccuucacccccaucuuccgaaccugggucacccgauagacaagccgagaugcuucagaaucugaccccaccgccuagcuaugcagccacgaucgcuaguaaguuggcgauucacaaccccaaucucccaaccacacugcccgugaacucucagaauauccagccugugagguacaaccggcgcuccaauccagacuuagaaaaacgaaggauucacuacugugauuaucccggaugcacuaaggucuacaccaaaagcucgcaucugaaggcacaccucagaacacauacuggcgagaagccuuauaaauguaccugggaaggcugcgacuggcgguucgcccguucugacgagcuuacacgccacuacagaaagcauaccggggcuaaaccguuucaauguggaguuugcaacagguccuucucacggagugaucaccuggccuugcacaugaagcgacaucagaacuga

SEQ ID NO: 9944 - RNA, 1353 nt, Artificial Sequence
  derived and/or modified sequence opt4 from Klf5__Homo_sapiens__AER93391
auggccaccagagugcugagcaugagcgccagacugggccccgugccccagccccccgccccccaggacgagcccguguucgcccagcugaagcccgugcugggcgccgccaaccccgccagagacgccgcccuguuccccggcgaggagcugaagcacgcccaccacagaccccaggccccccagcccgcccagccccccgccaccggccccagacugccccccgaggaccuggugcagaccagaugcgagauggagaaguaccugaccccccagcugccccccgugcccaucauccccgagcacaagaaguacagaagagacagcgccagcgugguggaccaguucuucaccgacaccgagggccugcccuacagcaucaacaugaacguguuccugcccgacaucacccaccugagaaccggccuguacaagagccagagacccugcgugacccacaucaagaccgagcccguggccaucuucagccaccagagcgagaccaccgcccccccccccgcccccacccaggcccugcccgaguucaccagcaucuucagcagccaccagaccgccgcccccgaggugaacaacaucuucaucaagcaggagcugcccacccccgaccugcaccugagcgugcccacccagcagggccaccuguaccagcugcugaacacccccgaccuggacaugcccagcagcaccaaccagaccgccgccauggacacccugaacgugagcaugagcgccgccauggccggccugaacacccacaccagcgccgugccccagaccgccgugaagcaguuccagggcaugccccccugcaccuacaccaugcccagccaguuccugccccagcaggccaccuacuucccccccagcccccccagcagcgagcccggcagccccgacagacaggccgagaugcugcagaaccugacccccccccccagcuacgccgccaccaucgccagcaagcuggccauccacaaccccaaccugcccaccacccugcccgugaacagccagaacauccagcccgugagauacaacagaagaagcaaccccgaccuggagaagagaagaauccacuacugcgacuaccccggcugcaccaagguguacaccaagagcagccaccugaaggcccaccugagaacccacaccggcgagaagcccuacaagugcaccugggagggcugcgacuggagauucgccagaagcgacgagcugaccagacacuacagaaagcacaccggcgccaagcccuuccagugcggcgugugcaacagaagcuucagcagaagcgaccaccuggcccugcacaugaagagacaccagaacuga

SEQ ID NO: 9945 - RNA, 1353 nt, Artificial Sequence
  derived and/or modified sequence opt5 from Klf5__Homo_sapiens__AER93391
auggccaccagagugcugagcauguccgcucggcucggccccgucccucagccgcccgccccucaagacgagcccguuuucgcgcagcugaagccugugcuuggggcugccaaccccgcccgcgaugcugcccuguuuccuggagaagaacucaaacacgcucaucacagaccgcaggcgccccagccugcccaacccccugccacaggcccccggcugccgccugaagaccuugugcagacgcgcugcgagauggaaaaguaccugacaccccagcucccucccguccccaucauuccugagcauaaaaaguauagacgggauucugcuagcgugguugaccaguucuuuaccgauaccgaggggcugccguacuccaucaauaugaacguguuccugcccgacauuacacaccuccgcaccggacuguauaaaucucaaagaccuugugucacacauaucaagaccgaacccguggccauuuuuagccaccaguccgagacgaccgcuccucccccggccccuacacaggcgcuucccgaguucaccucuaucuuuagcucccaccagacagccgcuccugagguuaauaacaucuucauuaagcaagagcugcccaccccugaucuccaucugagcgugcccacgcagcagggccaccuuuaccaacugcucaauacaccggaccuggauaugccuucuuccaccaaccagacagccgcuauggacacccugaaugucagcaugucugccgccauggcugggcucaacacccauacauccgcggugccccagacggccgugaaacaguuucaaggaaugcccccuugcaccuauacaaugccgagccaguuccugccccagcaggcuaccuacuuuccucccucuccucccuccagcgaaccuggcucccccgaucggcaagccgagaugcuucagaaucugacaccgccucccucuuaugccgcuaccaucgccagcaagcucgcgauucacaacccuaaucugcccacgacacuuccggucaacucccagaauauccagccuguucgcuacaacagacggagcaaucccgaccuggaaaaacgccggauucacuacugugauuauccuggcugcaccaagguguacaccaaaucuucccaucucaaggcucaccugagaacacauaccggggagaagcccuauaaauguacaugggaaggaugcgacuggcgcuucgccagaagcgacgagcugacgcggcacuacagaaagcauaccggcgccaaacccuuucaauguggggugugcaaccgcucuuucagccgguccgaucaccucgcucugcacaugaagagacaucagaacuga

SEQ ID NO: 9946 - RNA, 1353 nt, Artificial Sequence
  derived and/or modified sequence opt6 from Klf5__Homo_sapiens__AER93391
auggcaacuagaguacuaucuaugucagcacgacuagguccaguaccucaaccaccugcaccccaagaugaacccguauuugcccaauuaaaaccaguauuaggagcagcaaacccugcaagagacgcagcacuauucccaggagaagaacuaaaacacgcacaccaucgaccacaagcaccacaaccugcacaaccccccgcaacaggaccaagacuuccaccagaagauuuaguacaaacaagaugugaaauggaaaaguaucuaacaccacaacuaccaccaguaccaauaauaccagaacacaaaaaauacagaagagacucagcaucaguagucgaucaauucuuuacagacacagaaggauuaccauacucaauaaacaugaacguauuuuuaccagacauaacacaccuuagaacaggacucuacaaaucacaacgaccauguguaacccacauaaaaacagaaccaguugcaauauucucccaccaaucagaaacaaccgcacccccaccagccccaacccaagcccuaccagaauucacaucaauauucucuucacaucaaacugcagcaccagaaguaaacaacauauucauaaaacaagaacuacccacaccugauuuacaucuaaguguacccacacaacaaggacaccuauaucaauuacucaacacaccagaccucgauaugccaucaucaacuaaucaaacugcagcaauggacacacucaacguuucaaugucagcagccauggcuggucuuaacacccauacaucagcgguaccccaaacagcaguaaaacaauuucaaggaaugccaccaugcacauacacaaugccaucucaauuucuaccccaacaagcuacauacuuccccccaucaccaccauccucagaaccaggaucaccagaccgacaagccgaaauguuacagaaucuaacuccaccaccaucauacgcagcaacaaucgccucaaaacuugcaauacauaaccccaaccuaccuacuacauuacccgucaacucacaaaacauccaaccaguccgauacaacagaagaucaaauccugaccuagaaaaaagacgcauacacuauugcgacuaccccggcugcaccaaaguauacacaaaaucuucccaccuuaaagcacacuuaagaacacacaccggagaaaaaccauauaaaugcacaugggaaggaugcgacuggagauuugcacgauccgacgaacuaacucgucauuacagaaaacauacuggcgccaaacccuuucaaugcggaguaugcaaccgauccuucucaagaucagaucaucuagcauuacacaugaaaagacaccaaaacuaa

SEQ ID NO: 9947 - protein, 457 aa, Artificial Sequence
  Klf5__Homo_sapiens__Q13887
MATRVLSMSARLGPVPQPPAPQDEPVFAQLKPVLGAANPARDAALFPGEELKHAHHRPQAQPAPAQAPQPAQPPATGPRLPPEDLVQTRCEMEKYLTPQLPPVPIIPEHKKYRRDSASVVDQFFTDTEGLPYSINMNVFLPDITHLRTGLYKSQRPCVTHIKTEPVAIFSHQSETTAPPPAPTQALPEFTSIFSSHQTAAPEVNNIFIKQELPTPDLHLSVPTQQGHLYQLLNTPDLDMPSSTNQTAAMDTLNVSMSAAMAGLNTHTSAVPQTAVKQFQGMPPCTYTMPSQFLPQQATYFPPSPPSSEPGSPDRQAEMLQNLTPPPSYAATIASKLAIHNPNLPTTLPVNSQNIQPVRYNRRSNPDLEKRRIHYCDYPGCTKVYTKSSHLKAHLRTHTGEKPYKCTWEGCDWRFARSDELTRHYRKHTGAKPFQCGVCNRSFSRSDHLALHMKRHQN

SEQ ID NO: 9948 - RNA, 1374 nt, Artificial Sequence
  Klf5__Homo_sapiens__AAF18307
auggcuacaagggugcugagcaugagcgcccgccugggacccgugccccagccgccggcgccgcaggacgagccgguguucgcgcagcucaagccggugcugggcgccgcgaauccggcccgcgacgcggcgcucuuccccggcgaggagcugaagcacgcgcaccaccgcccgcaggcgcagcccgcgcccgcgcaggccccgcagccggcccagccgcccgccaccggcccgcggcugccuccagaggaccugguccaaacaagaugugaaauggagaaguaucugacaccucagcuuccuccaguuccuauaauuccagagcauaaaaaguauagacgagacagugccucagucguagaccaguucuucacugacacugaaggguuaccuuacaguaucaacaugaacgucuuccucccugacaucacucaccugagaacuggccucuacaaaucccagagaccgugcguaacacacaucaagacagaaccuguugccauuuucagccaccagagugaaacgacugccccuccuccggccccgacccaggcccucccugaguucaccaguauauucagcucacaccagaccgcagcuccagaggugaacaauauuuucaucaaacaagaacuuccuacaccagaucuucaucuuucugucccuacccagcagggccaccuguaccagcuacugaauacaccggaucuagauaugcccaguucuacaaaucagacagcagcaauggacacucuuaauguuucuaugucagcugccauggcaggccuuaacacacacaccucugcuguuccgcagacugcagugaaacaauuccagggcaugcccccuugcacauacacaaugccaagucaguuucuuccacaacaggccacuuacuuucccccgucaccaccaagcucagagccuggaaguccagauagacaagcagagaugcuccagaauuuaaccccaccuccauccuaugcugcuacaauugcuucuaaacuggcaauucacaauccaaauuuacccaccacccugccaguuaacucacaaaacauccaaccugucagauacaauagaaggaguaaccccgauuuggagaaacgacgcauccacuacugcgauuacccugguugcacaaaaguuuauaccaagucuucucauuuaaaagcucaccugaggacucacacuggugaaaagccauacaaguguaccugggaaggcugcgacuggagguucgcgcgaucggaugagcugacccgccacuaccggaagcacacaggcgccaagcccuuccagugcggggugugcaaccgcagcuucucgcgcucugaccaccuggcccugcauaugaagaggcaccagaacuga

SEQ ID NO: 9949 - RNA, 1374 nt, Artificial Sequence
  derived and/or modified sequence opt1 from Klf5__Homo_sapiens__AAF18307
auggccacccgcgugcugagcauguccgcccggcucggccccgucccgcagccgcccgcgccccaggacgagcccguguucgcccagcugaagcccgugcugggggccgccaaccccgcccgcgacgcggcccucuuccccggcgaggagcugaagcacgcccaccaccggccgcaggcccagcccgcgcccgcccaggcgccccagccggcccagccgcccgccaccgggccccgccugccgcccgaggaccucguccagacgcggugcgagauggagaaguaccugacgccccagcugccgcccgugcccaucauccccgagcacaagaaguaccgccgggacagcgccuccguggucgaccaguucuucaccgacaccgagggccuccccuacagcaucaacaugaacguguuccugcccgacaucacccaccuccgcaccgggcuguacaagucccagcggcccugcgugacccacaucaagaccgagcccgucgccaucuucagccaccaguccgagacgaccgcgcccccgcccgcccccacccaggcccugccggaguucaccagcaucuucuccagccaccagacggccgcccccgaggugaacaacaucuucaucaagcaggagcugcccacccccgaccuccaccuguccgugccgacccagcagggccaccuguaccagcuccugaacacccccgaccuggacaugcccagcuccacgaaccagaccgccgccauggacacccucaacgucagcauguccgccgcgauggccggccugaacacccacacgagcgccgugccccagaccgccgugaagcaguuccaggggaugccgcccugcaccuacaccaugcccucccaguuccugccccagcaggccacguacuucccgcccagcccgcccuccagcgagcccggcagccccgaccgccaggcggagaugcuccagaaccugaccccgccgcccuccuacgccgccaccaucgccagcaagcuggcgauccacaaccccaaccuccccaccacgcugcccgucaacucccagaacauccagcccgugcgguacaaccgccggagcaaccccgaccuggagaagcgccggauccacuacugcgacuaccccgggugcaccaagguguacaccaaguccagccaccucaaggcccaccuccgcacccacacgggcgagaagccguacaagugcaccugggaggggugcgacuggcgguucgcccgcuccgacgagcugacccggcacuaccgcaagcacaccggcgccaagcccuuccagugcggcgucugcaaccggagcuucucccgcagcgaccaccuggcccugcacaugaagcgccaccagaacuga

SEQ ID NO: 9950 - RNA, 1374 nt, Artificial Sequence
  derived and/or modified sequence opt2 from Klf5__Homo_sapiens__AAF18307
auggccacccgcguccucuccauguccgcccgccucggccccgucccccagccccccgccccccaggacgagcccgucuucgcccagcucaagcccguccucggcgccgccaaccccgcccgcgacgccgcccucuuccccggcgaggagcucaagcacgcccaccaccgcccccaggcccagcccgcccccgcccaggccccccagcccgcccagccccccgccaccggcccccgccucccccccgaggaccucguccagacccgcugcgagauggagaaguaccucaccccccagcucccccccguccccaucauccccgagcacaagaaguaccgccgcgacuccgccuccgucgucgaccaguucuucaccgacaccgagggccuccccuacuccaucaacaugaacgucuuccuccccgacaucacccaccuccgcaccggccucuacaagucccagcgccccugcgucacccacaucaagaccgagcccgucgccaucuucucccaccaguccgagaccaccgcccccccccccgcccccacccaggcccuccccgaguucaccuccaucuucuccucccaccagaccgccgcccccgaggucaacaacaucuucaucaagcaggagcuccccacccccgaccuccaccucuccguccccacccagcagggccaccucuaccagcuccucaacacccccgaccucgacaugcccuccuccaccaaccagaccgccgccauggacacccucaacgucuccauguccgccgccauggccggccucaacacccacaccuccgccgucccccagaccgccgucaagcaguuccagggcaugccccccugcaccuacaccaugcccucccaguuccucccccagcaggccaccuacuucccccccuccccccccuccuccgagcccggcucccccgaccgccaggccgagaugcuccagaaccucacccccccccccuccuacgccgccaccaucgccuccaagcucgccauccacaaccccaaccuccccaccacccuccccgucaacucccagaacauccagcccguccgcuacaaccgccgcuccaaccccgaccucgagaagcgccgcauccacuacugcgacuaccccggcugcaccaaggucuacaccaaguccucccaccucaaggcccaccuccgcacccacaccggcgagaagcccuacaagugcaccugggagggcugcgacuggcgcuucgcccgcuccgacgagcucacccgccacuaccgcaagcacaccggcgccaagcccuuccagugcggcgucugcaaccgcuccuucucccgcuccgaccaccucgcccuccacaugaagcgccaccagaacuga

SEQ ID NO: 9951 - RNA, 1374 nt, Artificial Sequence
  derived and/or modified sequence opt3 from Klf5__Homo_sapiens__AAF18307
auggccaccagagugcugagcauguccgcuaggcucggccccgucccucagccaccggcaccccaagacgagccuguuuucgcccagcuuaagccagugcugggggcggcuaaccccgcccgggaugcagccuuguuuccuggagaagaguuaaaacacgcucaucaccgcccacaggcacagcccgccccugcucaagccccacagccggcgcagcccccugcaacagguccacgacugcccccugaagaccuaguacagacucguugcgagauggaaaaguaccucacgccacaacugcccccggugccuaucauucccgagcauaaaaaguauagaagggauucugccucagucguggaccaguucuuuaccgauacagagggccuuccauacaguauaaauaugaacguuuuccugccugacaucacucacuugcggaccgggcucuauaaaagccagcgccccugugugacacauauuaagaccgaaccagucgcuaucuuuucccaccagucugagacuacagcacccccuccagccccgacccaagcucugcccgaauuuacgucgauuuucucaagccaccagacugccgcgccugaggugaauaacaucuucauaaagcaggagcugccaacccccgaucuccauuuaaguguaccuacacaacagggacaccuguaccagcuuuugaauacuccagaccuggauaugcccuccucuaccaaccagacagccgcaauggacacccuaaauguuagcauguccgcugccauggcuggccucaacacgcauacuucagccgugccgcaaacagcagucaaacaguuucaggguaugccuccaugcaccuauacuaugcccagucaguuccugccucaacaggccacauacuuucccccaagcccucccucuuccgaaccagggucaccggauagacaggcugagaugcuucagaaucugaccccucccccaagcuaugcggcaacgaucgccaguaaguuggcuauucacaaccccaaucucccuaccacacugccagugaacucucaaaauauccagcccgugagguacaaccggcgcuccaauccugacuuagaaaaacgaaggauucacuacugugauuauccgggaugcacuaaggucuacaccaaaagcucgcaucugaaggcccaccucagaacacauacuggcgagaagccauauaaauguaccugggaaggcugcgacuggcgguucgcacguucugacgagcuuacacgccacuacagaaagcauaccggggccaaacccuuucaguguggaguuugcaacagguccuucucacggagugaucaccuggcuuugcacaugaagcgacaucagaacuga

SEQ ID NO: 9952 - RNA, 1374 nt, Artificial Sequence
  derived and/or modified sequence opt4 from Klf5__Homo_sapiens__AAF18307
auggccaccagagugcugagcaugagcgccagacugggccccgugccccagccccccgccccccaggacgagcccguguucgcccagcugaagcccgugcugggcgccgccaaccccgccagagacgccgcccuguuccccggcgaggagcugaagcacgcccaccacagaccccaggcccagcccgcccccgcccaggccccccagcccgcccagccccccgccaccggccccagacugccccccgaggaccuggugcagaccagaugcgagauggagaaguaccugaccccccagcugccccccgugcccaucauccccgagcacaagaaguacagaagagacagcgccagcgugguggaccaguucuucaccgacaccgagggccugcccuacagcaucaacaugaacguguuccugcccgacaucacccaccugagaaccggccuguacaagagccagagacccugcgugacccacaucaagaccgagcccguggccaucuucagccaccagagcgagaccaccgcccccccccccgcccccacccaggcccugcccgaguucaccagcaucuucagcagccaccagaccgccgcccccgaggugaacaacaucuucaucaagcaggagcugcccacccccgaccugcaccugagcgugcccacccagcagggccaccuguaccagcugcugaacacccccgaccuggacaugcccagcagcaccaaccagaccgccgccauggacacccugaacgugagcaugagcgccgccauggccggccugaacacccacaccagcgccgugccccagaccgccgugaagcaguuccagggcaugccccccugcaccuacaccaugcccagccaguuccugccccagcaggccaccuacuucccccccagcccccccagcagcgagcccggcagccccgacagacaggccgagaugcugcagaaccugacccccccccccagcuacgccgccaccaucgccagcaagcuggccauccacaaccccaaccugcccaccacccugcccgugaacagccagaacauccagcccgugagauacaacagaagaagcaaccccgaccuggagaagagaagaauccacuacugcgacuaccccggcugcaccaagguguacaccaagagcagccaccugaaggcccaccugagaacccacaccggcgagaagcccuacaagugcaccugggagggcugcgacuggagauucgccagaagcgacgagcugaccagacacuacagaaagcacaccggcgccaagcccuuccagugcggcgugugcaacagaagcuucagcagaagcgaccaccuggcccugcacaugaagagacaccagaacuga

SEQ ID NO: 9953 - RNA, 1374 nt, Artificial Sequence
  derived and/or modified sequence opt5 from Klf5__Homo_sapiens__AAF18307
auggccaccagagugcugagcauguccgcucggcucggccccgucccucagccgcccgccccucaagacgagcccguuuucgcgcagcugaagccugugcuuggggcugccaaccccgcccgcgaugcugcccuguuuccuggagaagaacucaaacacgcucaucacagaccgcaggcccagcccgcgccugcccaagcuccccagccugcccagcccccggcuacaggcccucggcugcccccugaagaccuugugcagacgcgcugcgagauggaaaaguaccugacaccccaacugcccccugucccgaucauucccgagcauaaaaaguauagacgggauucugccagcgugguugaccaguucuuuaccgauaccgaggggcugccuuacuccaucaauaugaacguguuccugcccgacauuacacaccuccgcaccggacuguauaaaucucagagaccuugugucacacauaucaagaccgaacccguggcgauuuuuagccaccaguccgagacgaccgccccgccucccgcuccuacacaagcccuucccgaguucaccucuaucuuuagcucccaccagacagcugccccugagguuaauaacaucuucauuaagcaggagcugcccaccccggaucuccaucugagcgugccuacgcaacagggccaccuuuaccagcugcucaauacacccgaccuggauaugcccucuuccaccaaccagacagccgcuauggacacccugaaugucagcaugucugcggccauggcugggcucaacacccauacauccgccgugccucaaacggccgugaaacaguuucagggaaugccgcccugcaccuauacaaugccuagccaguuccugccccaacaggcuaccuacuuuccucccucuccucccuccagcgaaccgggcuccccugaucggcaggccgagaugcuucagaaucugacacccccucccucuuaugcggcuaccaucgccagcaagcucgccauucacaacccgaaucugccuacgacacuucccgucaacucccaaaauauccagccuguucgcuacaacagacggagcaaucccgaccuggaaaaacgccggauucacuacugugauuaucccggcugcaccaagguguacaccaaaucuucccaucucaaggcucaccucagaacacauaccggggagaagccuuauaaauguacaugggaaggaugcgacuggcgcuucgccagaagcgacgagcugacgcggcacuacagaaagcauaccggcgcuaaaccguuucaguguggggugugcaaccgcucuuucagccgguccgaucaccucgcccugcacaugaagagacaucagaacuga

SEQ ID NO: 9954 - RNA, 1374 nt, Artificial Sequence
  derived and/or modified sequence opt6 from Klf5__Homo_sapiens__AAF18307
auggcuaccagaguacuaucaaugucagcaagauuaggacccguuccacaaccaccagcaccacaagacgaaccaguauucgcacaauuaaaaccaguacuaggagcagccaacccagcaagagacgcagccuuauucccaggcgaagaacuaaaacaugcacaucaccgaccacaagcucaacccgcaccagcccaagccccacaaccagcacaaccaccagcaaccggaccaagacuaccaccagaagaccuaguacaaacacgcugcgaaauggaaaaauaccuaacaccacaacuaccaccaguuccaauaauaccagaacauaaaaaauaccguagagauuccgcaucaguaguagaccaauuuuucacagacacagaaggccuaccauacuccauaaauaugaauguauucuuaccagacauaacacacuuacgaacaggccuauauaaaucacaaagacccugcguuacacacauuaaaacagaaccuguagcaauauucucacaccaaucagaaaccacagccccaccuccagcaccaacacaagcacuaccagaauuuacaucuauauucuccucucaucaaaccgcagcuccagaaguuaacaacaucuucauaaaacaagaacuaccaacuccagaccuacaccuaucagucccaacacaacaaggacaccuauaucaacuacuuaacacuccagaccucgacaugccauccucaacaaaucaaacugccgcaauggauacuuuaaacguaucaauguccgcugccauggcaggccuaaacacucacacaucagcaguuccacaaacagccguaaaacaauuccaaggaaugccacccugcaccuacacuaugcccucacaauuuuuaccacaacaagcaacauacuucccccccagcccaccauccucugaaccaggauccccagacagacaagcagaaaugcuccaaaaccuuacuccaccacccucuuaugcagcaacaauagcuucaaaacuugcaauccacaauccaaaucucccaacuacacuuccaguaaacucccaaaauauccaaccaguaagauauaacagaagaucaaauccagaccuggaaaaaagaagaauacacuacugcgacuauccaggcugcacaaaagucuacacaaaaucaucacaccuaaaagcacaccuaagaacacauaccggcgaaaaaccauacaaauguacaugggaaggcugugacuggagauucgcaagaucagacgaacuaacucgacauuaccgcaaacacacuggagcaaaaccauuucaauguggaguaugcaacagauccuucucacguucagaucauuuagcacuccacaugaaaagacaccaaaacuaa

SEQ ID NO: 9955 - protein, 457 aa, Artificial Sequence; identical to SEQ ID NO: 9947
  Klf5__Homo_sapiens__Q5T6X2

SEQ ID NO: 9956 - RNA, 1374 nt, Artificial Sequence
  Klf5__Homo_sapiens__AAP35287
auggcuacaagggugcugagcaugagcgcccgccugggacccgugccccagccgccggcgccgcaggacgagccgguguucgcgcagcucaagccggugcugggcgccgcgaauccggcccgcgacgcggcgcucuuccccggcgaggagcugaagcacgcgcaccaccgcccgcaggcgcagcccgcgcccgcgcaggccccgcagccggcccagccgcccgccaccggcccgcggcugccuccagaggaccugguccagacaagaugugaaauggagaaguaucugacaccucagcuuccuccaguuccuauaauuccagagcauaaaaaguauagacgagacagugccucagucguagaccaguucuucacugacacugaaggguuaccuuacaguaucaacaugaacgucuuccucccugacaucacucaccugagaacuggccucuacaaaucccagagaccgugcguaacacacaucaagacagaaccuguugccauuuucagccaccagagugaaacgacugccccuccuccggccccgacccaggcccucccugaguucaccaguauauucagcucacaccagaccgcagcuccagaggugaacaauauuuucaucaaacaagaacuuccuacaccagaucuucaucuuucugucccuacccagcagggccaccuguaccagcuacugaauacaccggaucuagauaugcccaguucuacaaaucagacagcagcaauggacacucuuaauguuucuaugucagcugccauggcaggccuuaacacacacaccucugcuguuccgcagacugcagugaaacaauuccagggcaugcccccuugcacauacacaaugccaagucaguuucuuccacaacaggccacuuacuuucccccgucaccaccaagcucagagccuggaaguccagauagacaagcagagaugcuccagaauuuaaccccaccuccauccuaugcugcuacaauugcuucuaaacuggcaauucacaauccaaauuuacccaccacccugccaguuaacucacaaaacauccaaccugucagauacaauagaaggaguaaccccgauuuggagaaacgacgcauccacuacugcgauuacccugguugcacaaaaguuuauaccaagucuucucauuuaaaagcucaccugaggacucacacuggugaaaagccauacaaguguaccugggaaggcugcgacuggagguucgcgcgaucggaugagcugacccgccacuaccggaagcacacaggcgccaagcccuuccagugcggggugugcaaccgcagcuucucgcgcucugaccaccuggcccugcauaugaagaggcaccagaacuag

SEQ ID NO: 9957 - RNA, 1374 nt, Artificial Sequence; identical to SEQ ID NO: 9949
  derived and/or modified sequence opt1 from Klf5__Homo_sapiens__AAP35287

SEQ ID NO: 9958 - RNA, 1374 nt, Artificial Sequence; identical to SEQ ID NO: 9950
  derived and/or modified sequence opt2 from Klf5__Homo_sapiens__AAP35287

SEQ ID NO: 9959 - RNA, 1374 nt, Artificial Sequence; identical to SEQ ID NO: 9951
  derived and/or modified sequence opt3 from Klf5__Homo_sapiens__AAP35287

SEQ ID NO: 9960 - RNA, 1374 nt, Artificial Sequence; identical to SEQ ID NO: 9952
  derived and/or modified sequence opt4 from Klf5__Homo_sapiens__AAP35287

SEQ ID NO: 9961 - RNA, 1374 nt, Artificial Sequence; identical to SEQ ID NO: 9953
  derived and/or modified sequence opt5 from Klf5__Homo_sapiens__AAP35287

SEQ ID NO: 9962 - RNA, 1374 nt, Artificial Sequence
  derived and/or modified sequence opt6 from Klf5__Homo_sapiens__AAP35287
auggcaacaagaguccucuccaugucagcaagacuaggacccguaccccaacccccagccccacaagacgaaccaguauucgcacaacuaaaacccguccuaggugcagcaaacccagcucgagaugccgccuuauucccaggugaagaauuaaaacacgcacaucaccgaccacaagcucaaccugcaccagcacaagcaccacaacccgcacaaccccccgcaacaggcccccgacuaccucccgaagaccucguacaaaccagaugcgaaauggaaaaauaccuaaccccccaacuaccucccguuccuauaauccccgaacacaaaaaauacagaagagacucagcaucaguuguugaucaauucuuuacagacaccgaaggacuacccuauucuaucaauaugaacgucuuucuuccagauauaacucauuuaagaacagguuuauacaaaucacaacgacccugcguuacccacauuaaaacagaacccguagcaauauucucacaccaaucagaaacaaccgcaccacccccagcaccaacacaagcauuaccagaauucacauccauuuuuuccucucaucaaaccgccgccccagaaguaaacaacauauucauaaaacaagaauuaccaacuccagaucuacaccuauccguaccaacccaacaaggacacuuauaucaacuacuaaacacaccagaccuugacaugccauccucuacuaaucaaacagccgcaauggacacacuaaacguaucaaugucugccgcaauggcaggacuaaauacccacacauccgcaguaccacaaaccgcuguaaaacaauuucaaggaaugccacccugcaccuauacaaugccaucacaauuccuuccacaacaagcaaccuacuucccaccaucaccuccauccucagaaccaggaucaccagaccgacaagcagaaaugcuccaaaaccucacccccccacccuccuacgccgcaacaauagccucaaaacuagcaauccacaaccccaaccuucccacaaccuuacccguaaacucccaaaacauucaaccaguacgcuacaaccgaagaucaaaucccgaccuagaaaaaagaagaauacacuacugugacuacccagguuguacuaaaguauauacaaaaucgucacaccuaaaagcacauuuacgaacacauaccggagaaaaaccuuacaaaugcacaugggaagguugugauuggagauucgcucgauccgaugaacuaacaagacacuaccgaaaacacacaggcgcaaaaccauuccaaugcggcguaugcaacagaucauucucaagauccgaucaccuugcacuucacaugaaacgacaccaaaacuaa

SEQ ID NO: 9963 - protein, 209 aa, Artificial Sequence
  LIN28__Homo_sapiens__Q9H9Z2
MGSVSNQQFAGGCAKAAEEAPEEAPEDAARAADEPQLLHGAGICKWFNVRMGFGFLSMTARAGVALDPPVDVFVHQSKLHMEGFRSLKEGEAVEFTFKKSAKGLESIRVTGPGGVFCIGSERRPKGKSMQKRRSKGDRCYNCGGLDHHAKECKLPPQPKKCHFCQSISHMVASCPLKAQQGPSAQGKPTYFREEEEEIHSPTLLPEAQN

SEQ ID NO: 9964 - RNA, 630 nt, Artificial Sequence
  LIN28__Homo_sapiens__AAH28566
augggcuccguguccaaccagcaguuugcagguggcugcgccaaggcggcagaagaggcgcccgaggaggcgccggaggacgcggcccgggcggcggacgagccucagcugcugcacggugcgggcaucuguaagugguucaacgugcgcaugggguucggcuuccuguccaugaccgcccgcgccggggucgcgcucgaccccccaguggaugucuuugugcaccagaguaagcugcacauggaaggguuccggagcuugaaggagggugaggcaguggaguucaccuuuaagaagucagccaagggucuggaauccauccgugucaccggaccugguggaguauucuguauugggagugagaggcggccaaaaggaaagagcaugcagaagcgcagaucaaaaggagacaggugcuacaacuguggaggucuagaucaucaugccaaggaaugcaagcugccaccccagcccaagaagugccacuucugccagagcaucagccauaugguagccucauguccgcugaaggcccagcagggcccuagugcacagggaaagccaaccuacuuucgagaggaagaagaagaaauccacagcccuacccugcucccggaggcacagaauuga

SEQ ID NO: 9965 - RNA, 630 nt, Artificial Sequence
  derived and/or modified sequence opt1 from LIN28__Homo_sapiens__AAH28566
augggcagcguguccaaccagcaguucgccgggggcugcgccaaggcggccgaggaggcccccgaggaggccccggaggacgccgcgcgcgccgccgacgagccccagcugcuccacggggccggcaucugcaagugguucaacguccggaugggguucggcuuccugagcaugaccgcgcgcgccggcguggcccuggacccgcccguggacgucuucgugcaccaguccaagcuccacauggagggguuccggagccugaaggagggcgaggccguggaguucaccuucaagaaguccgccaaggggcuggagagcauccgcgucacgggccccgggggcguguucugcaucggcuccgagcggcgccccaagggcaagagcaugcagaagcggcgcuccaagggggaccggugcuacaacugcgggggccucgaccaccacgcgaaggagugcaagcugccgccccagcccaagaagugccacuucugccagagcaucucccacaugguggccagcugcccccugaaggcccagcagggccccuccgcccaggggaagcccaccuacuuccgcgaggaggaggaggagauccacagcccgacccuccugcccgaggcccagaacuga

SEQ ID NO: 9966 - RNA, 630 nt, Artificial Sequence
  derived and/or modified sequence opt2 from LIN28__Homo_sapiens__AAH28566
augggcuccgucuccaaccagcaguucgccggcggcugcgccaaggccgccgaggaggcccccgaggaggcccccgaggacgccgcccgcgccgccgacgagccccagcuccuccacggcgccggcaucugcaagugguucaacguccgcaugggcuucggcuuccucuccaugaccgcccgcgccggcgucgcccucgacccccccgucgacgucuucguccaccaguccaagcuccacauggagggcuuccgcucccucaaggagggcgaggccgucgaguucaccuucaagaaguccgccaagggccucgaguccauccgcgucaccggccccggcggcgucuucugcaucggcuccgagcgccgccccaagggcaaguccaugcagaagcgccgcuccaagggcgaccgcugcuacaacugcggcggccucgaccaccacgccaaggagugcaagcuccccccccagcccaagaagugccacuucugccaguccaucucccacauggucgccuccugcccccucaaggcccagcagggccccuccgcccagggcaagcccaccuacuuccgcgaggaggaggaggagauccacucccccacccuccuccccgaggcccagaacuga

SEQ ID NO: 9967 - RNA, 630 nt, Artificial Sequence
  derived and/or modified sequence opt3 from LIN28__Homo_sapiens__AAH28566
augggcagcguguccaaccagcaauucgccgggggaugcgcuaaggcagccgaggaagcgcccgaggaagcuccugaggacgccgcaagagccgcugaugaaccacagcugcuccacggugcaggcaucuguaaaugguuuaaugucaggaugggguucggauuucuuucuaugaccgcccgggcuggcguugcccuggacccgcccguggauguauucgugcaucagucaaaguugcacauggaggguuuucgcaguuuaaaagagggggaagcggucgaguucacauuuaagaaaagcgcaaagggacuggaauccauucgagugacuggcccuggcgggguuuucugcauaggaucugagcguagaccaaaggguaaaucgaugcagaagaggcggucaaaaggcgaccgcuguuacaacugcgggggacuagaucaucacgccaaggaguguaaacugcccccucaaccaaagaagugccauuuuugucagagcaucagucacaugguggcuuccugcccccucaaagcccagcagggcccuucugcacaagguaagccaacguauuucagagaagaggaagaggaaauucacagcccgacccuucugcccgaggcucagaauuga

SEQ ID NO: 9968 - RNA, 630 nt, Artificial Sequence
  derived and/or modified sequence opt4 from LIN28__Homo_sapiens__AAH28566
augggcagcgugagcaaccagcaguucgccggcggcugcgccaaggccgccgaggaggcccccgaggaggcccccgaggacgccgccagagccgccgacgagccccagcugcugcacggcgccggcaucugcaagugguucaacgugagaaugggcuucggcuuccugagcaugaccgccagagccggcguggcccuggacccccccguggacguguucgugcaccagagcaagcugcacauggagggcuucagaagccugaaggagggcgaggccguggaguucaccuucaagaagagcgccaagggccuggagagcaucagagugaccggccccggcggcguguucugcaucggcagcgagagaagacccaagggcaagagcaugcagaagagaagaagcaagggcgacagaugcuacaacugcggcggccuggaccaccacgccaaggagugcaagcugcccccccagcccaagaagugccacuucugccagagcaucagccacaugguggccagcugcccccugaaggcccagcagggccccagcgcccagggcaagcccaccuacuucagagaggaggaggaggagauccacagccccacccugcugcccgaggcccagaacuga

SEQ ID NO: 9969 - RNA, 630 nt, Artificial Sequence
  derived and/or modified sequence opt5 from LIN28__Homo_sapiens__AAH28566
augggcagcguguccaaccagcaauucgccgggggaugcgcuaaggccgcggaggaagcucccgaggaagccccugaggacgccgcuagagccgcugaugaaccgcagcugcuccacggcgccgggaucuguaaaugguuuaauguccggaugggauucggcuuucugucuaugaccgcgcgcgccgggguugcucuugaucccccuguggacguguucguccaucagagcaagcugcacauggagggauuuagaucccucaaagagggcgaagccguggaguucacauuuaagaaaucugcuaagggccuggaaagcauucggguuacggggcccggaggcguguucugcaucggguccgagcgcagaccuaagggaaaaucuaugcagaagcggcgcagcaaaggcgacagauguuacaacugcgggggacuugaucaucacgccaaggaguguaaacugcccccucaaccgaagaagugccauuuuugucaguccauuagccacauggucgcgucuugcccccucaaagcccagcagggcccuuccgcucaaggcaagcccaccuauuuccgggaagaggaagaggaaauccacagcccuacacugcugcccgaggcccagaauuga

SEQ ID NO: 9970 - RNA, 630 nt, Artificial Sequence
  derived and/or modified sequence opt6 from LIN28__Homo_sapiens__AAH28566
augggaucaguaucaaaucaacaauuugcaggaggaugugcaaaagcagcagaagaagcaccagaagaagcaccagaagaugcagcaagagcagcagaugaaccacaauuacuacauggagcaggaauaugcaaaugguuuaacguaagaaugggauuuggauuucuaucaaugacagcaagagcaggagucgcacuagauccaccaguagacguauuuguacaucaaaguaaauuacauauggaaggauucaggaguuuaaaagaaggagaagcaguagaauuuacauuuaaaaaaagcgcaaaaggacuagaaagcauaagaguuacaggaccaggaggaguauucuguauaggaagcgaaagaagaccaaaaggaaaaagcaugcaaaaaagaagaagcaaaggagauagauguuacaauugcggaggauuagaccaucacgcaaaagaaugcaaauuaccaccacaaccaaaaaaaugucacuuuugccaaaguauaagccacaugguagcaucaugcccauuaaaagcacaacaaggaccaucagcacaaggaaaaccaacauacuuuagagaagaagaagaagaaauacauagcccaacauuacuaccagaagcacaaaauuaa

SEQ ID NO: 9971 - protein, 139 aa, Artificial Sequence
  L-myc__Homo_sapiens__A0A0A0N0L0
MDYDSYQHYFYDYDCGEDFYRSTAPSEDIWKKFELVPSPPTSPPWGLGPGAGDPAPGIGPPEPWPGGCTGDEAESRGHSKGWGRNYASIIRRDCMWSGFSASKPATRRPPPPVRWANPRPRPAPGPRAQATRRMKKLML

SEQ ID NO: 9972 - RNA, 420 nt, Artificial Sequence
  L-myc__Homo_sapiens__AER93388
auggacuacgacucguaccagcacuauuucuacgacuaugacugcggggaggauuucuaccgcuccacggcgcccagcgaggacaucuggaagaaauucgagcuggugccaucgccccccacgucgccgcccuggggcuugggucccggcgcaggggacccggcccccgggauuggucccccggagccguggcccggagggugcaccggagacgaagcggaaucccggggccacucgaaaggcuggggcaggaacuacgccuccaucauacgccgugacugcauguggagcggcuucucagccucgaagccggcaacccggcgcccgccgcccccuguccgcugggcgaacccaagacccaggccugcuccggguccgagagcccaagcgacucggagaaugaagaaauugauguuguga

SEQ ID NO: 9973 - RNA, 420 nt, Artificial Sequence
  derived and/or modified sequence opt1 from L-myc__Homo_sapiens__AER93388
auggacuacgacagcuaccagcacuacuucuacgacuacgacugcggcgaggacuucuaccgcuccaccgcccccagcgaggacaucuggaagaaguucgagcuggugcccuccccgcccaccagcccgcccugggggcucggccccggggccggcgaccccgcgcccgggaucggcccgcccgagcccuggcccggcgggugcacgggcgacgaggccgagucccgggggcacagcaagggcugggggcgcaacuacgccuccaucauccggcgcgacugcauguggagcggcuucuccgccagcaagccggccacccggcgcccgcccccgcccguccggugggcgaacccccgcccccggcccgcccccggcccccgcgcccaggccacccggcgcaugaagaagcugaugcuguga

SEQ ID NO: 9974 - RNA, 420 nt, Artificial Sequence
  derived and/or modified sequence opt2 from L-myc__Homo_sapiens__AER93388
auggacuacgacuccuaccagcacuacuucuacgacuacgacugcggcgaggacuucuaccgcuccaccgcccccuccgaggacaucuggaagaaguucgagcucguccccuccccccccaccuccccccccuggggccucggccccggcgccggcgaccccgcccccggcaucggcccccccgagcccuggcccggcggcugcaccggcgacgaggccgagucccgcggccacuccaagggcuggggccgcaacuacgccuccaucauccgccgcgacugcaugugguccggcuucuccgccuccaagcccgccacccgccgcccccccccccccguccgcugggccaacccccgcccccgccccgcccccggcccccgcgcccaggccacccgccgcaugaagaagcucaugcucuga

SEQ ID NO: 9975 - RNA, 420 nt, Artificial Sequence
  derived and/or modified sequence opt3 from L-myc__Homo_sapiens__AER93388
auggacuacgauagcuaucagcacuacuucuaugacuacgauugcggcgaggacuuuuauagauccaccgcccccucugaagauaucuggaagaaauucgagcuggugccuucaccaccgacaagucccccuugggggcucggaccaggugcuggcgaccccgcaccugggauuggaccacccgaaccuuggccaggcgguuguacuggggaugaggccgaaagcaggggacauuccaagggcuggggccggaacuacgcgucuauaauccgccgagacugcauguggucgggguuuucagcuagcaaaccggccacgcguagacccccuccacccgucaggugggcaaauccucggccacgccccgccccgggaccuagagcucaagcaaccaggcggaugaagaaacuuaugcuguga

SEQ ID NO: 9976 - RNA, 420 nt, Artificial Sequence
  derived and/or modified sequence opt4 from L-myc__Homo_sapiens__AER93388
auggacuacgacagcuaccagcacuacuucuacgacuacgacugcggcgaggacuucuacagaagcaccgcccccagcgaggacaucuggaagaaguucgagcuggugcccagcccccccaccagcccccccuggggccugggccccggcgccggcgaccccgcccccggcaucggcccccccgagcccuggcccggcggcugcaccggcgacgaggccgagagcagaggccacagcaagggcuggggcagaaacuacgccagcaucaucagaagagacugcauguggagcggcuucagcgccagcaagcccgccaccagaagaccccccccccccgugagaugggccaaccccagacccagacccgcccccggccccagagcccaggccaccagaagaaugaagaagcugaugcuguga

SEQ ID NO: 9977 - RNA, 420 nt, Artificial Sequence
  derived and/or modified sequence opt5 from L-myc__Homo_sapiens__AER93388
auggacuacgauagcuaucagcacuacuucuaugacuacgauugcggcgaggacuuuuauagauccaccgcccccucugaagauaucuggaagaaauucgagcuggugccuagcccgcccacauccccucccugggggcucggaccuggcgcuggggaccccgccccuggaauuggcccgcccgaaccuuggcccgggggauguacgggcgaugaggcggaaucucggggccauagcaagggguggggacgcaacuacgcuuccaucauuagacgggacugcauguggucuggcuuuagcgccuccaaaccugccacccgcagacccccgccucccguccggugggcuaauccucgccccagacccgccccugggccgcgggcucaagccacacgcagaaugaagaaacugaugcuuuga

SEQ ID NO: 9978 - RNA, 420 nt, Artificial Sequence
  derived and/or modified sequence opt6 from L-myc__Homo_sapiens__AER93388
auggauuaugauucauaucaacauuauuuuuaugauuaugauuguggagaagauuuuuauagaaguacagcaccaagugaagauauauggaaaaaauuugaauuaguaccaaguccaccaacaagcccaccauggggacuaggaccaggagcaggagauccagcaccaggaauaggaccaccagaaccauggccaggaggauguacaggagaugaagcagaaucaagaggacauucaaaaggauggggaagaaauuaugcaaguauaauaagaagagauuguauguggucaggauuuagugcaaguaaaccagcaacaagaagaccaccaccaccaguaagaugggcaaauccaagaccaagaccagcaccaggaccaagagcacaagcaacaagaagaaugaaaaaauuaauguuauaa

SEQ ID NO: 9979 - protein, 305 aa, Artificial Sequence
  Nanog__Homo_sapiens__Q9H9S0
MSVDPACPQSLPCFEASDCKESSPMPVICGPEENYPSLQMSSAEMPHTETVSPLPSSMDLLIQDSPDSSTSPKGKQPTSAEKSVAKKEDKVPVKKQKTRTVFSSTQLCVLNDRFQRQKYLSLQQMQELSNILNLSYKQVKTWFQNQRMKSKRWQKNNWPKNSNGVTQKASAPTYPSLYSSYHQGCLVNPTGNLPMWSNQTWNNSTWSNQTQNIQSWSNHSWNTQTWCTQSWNNQAWNSPFYNCGEESLQSCMQFQPNSPASDLEAALEAAGEGLNVIQQTTRYFSTPQTMDLFLNYSMNMQPEDV

SEQ ID NO: 9980 - RNA, 918 nt, Artificial Sequence
  Nanog__Homo_sapiens__AAP49529
augaguguggauccagcuuguccccaaagcuugccuugcuuugaagcauccgacuguaaagaaucuucaccuaugccugugauuugugggccugaagaaaacuauccauccuugcaaaugucuucugcugagaugccucacacggagacugucucuccucuuccuuccuccauggaucugcuuauucaggacagcccugauucuuccaccagucccaaaggcaaacaacccacuucugcagagaagagugucgcaaaaaaggaagacaaggucccggucaagaaacagaagaccagaacuguguucucuuccacccagcuguguguacucaaugauagauuucagagacagaaauaccucagccuccagcagaugcaagaacucuccaacauccugaaccucagcuacaaacaggugaagaccugguuccagaaccagagaaugaaaucuaagagguggcagaaaaacaacuggccgaagaauagcaauggugugacgcagaaggccucagcaccuaccuaccccagccuuuacucuuccuaccaccagggaugccuggugaacccgacugggaaccuuccaauguggagcaaccagaccuggaacaauucaaccuggagcaaccagacccagaacauccaguccuggagcaaccacuccuggaacacucagaccuggugcacccaauccuggaacaaucaggccuggaacagucccuucuauaacuguggagaggaaucucugcaguccugcaugcaguuccagccaaauucuccugccagugacuuggaggcugccuuggaagcugcuggggaaggccuuaauguaauacagcagaccacuagguauuuuaguacuccacaaaccauggauuuauuccuaaacuacuccaugaacaugcaaccugaagacguguga

SEQ ID NO: 9981 - RNA, 918 nt, Artificial Sequence
  derived and/or modified sequence opt1 from Nanog__Homo_sapiens__AAP49529
augagcguggaccccgccugcccgcagucccugcccugcuucgaggccagcgacugcaaggaguccagccccaugcccgucaucugcggcccggaggagaacuaccccucccuccagaugagcuccgcggagaugccccacaccgagaccgugagcccccugccguccagcauggaccugcucauccaggacucccccgacagcuccaccagccccaaggggaagcagcccaccuccgccgagaaguccguggccaagaaggaggacaaggucccggugaagaagcagaagacccgcaccguguucagcagcacgcagcugugcguccugaacgaccgguuccagcgccagaaguaccucucccugcagcagaugcaggagcugagcaacauccucaaccugagcuacaagcaggucaagaccugguuccagaaccagcggaugaaguccaagcgcuggcagaagaacaacuggcccaagaacagcaacggcgugacccagaaggccuccgcccccaccuaccccagccuguacuccagcuaccaccaggggugccucgugaacccgacgggcaaccugcccaugugguccaaccagaccuggaacaacagcaccugguccaaccagacccagaacauccagagcugguccaaccacagcuggaacacgcagaccuggugcacccaguccuggaacaaccaggcguggaacagccccuucuacaacugcggggaggagucccugcagagcugcaugcaguuccagcccaacuccccggccagcgaccucgaggccgcccuggaggcggccggcgagggccugaacgugauccagcagaccacgcgguacuucuccacgccccagaccauggaccucuuccugaacuacagcaugaacaugcagcccgaggacguguga

SEQ ID NO: 9982 - RNA, 918 nt, Artificial Sequence
  derived and/or modified sequence opt2 from Nanog__Homo_sapiens__AAP49529
auguccgucgaccccgccugcccccagucccuccccugcuucgaggccuccgacugcaaggaguccucccccaugcccgucaucugcggccccgaggagaacuaccccucccuccagauguccuccgccgagaugccccacaccgagaccgucuccccccuccccuccuccauggaccuccucauccaggacucccccgacuccuccaccucccccaagggcaagcagcccaccuccgccgagaaguccgucgccaagaaggaggacaagguccccgucaagaagcagaagacccgcaccgucuucuccuccacccagcucugcguccucaacgaccgcuuccagcgccagaaguaccucucccuccagcagaugcaggagcucuccaacauccucaaccucuccuacaagcaggucaagaccugguuccagaaccagcgcaugaaguccaagcgcuggcagaagaacaacuggcccaagaacuccaacggcgucacccagaaggccuccgcccccaccuaccccucccucuacuccuccuaccaccagggcugccucgucaaccccaccggcaaccuccccaugugguccaaccagaccuggaacaacuccaccugguccaaccagacccagaacauccaguccugguccaaccacuccuggaacacccagaccuggugcacccaguccuggaacaaccaggccuggaacucccccuucuacaacugcggcgaggagucccuccaguccugcaugcaguuccagcccaacucccccgccuccgaccucgaggccgcccucgaggccgccggcgagggccucaacgucauccagcagaccacccgcuacuucuccaccccccagaccauggaccucuuccucaacuacuccaugaacaugcagcccgaggacgucuga

SEQ ID NO: 9983 - RNA, 918 nt, Artificial Sequence
  derived and/or modified sequence opt3 from Nanog__Homo_sapiens__AAP49529
augagcguggaccccgccugcccucagucccugccauguuucgaggcuucugauugcaaggaaucaaguccgaugcccgucaucuguggcccugaggaaaacuacccaagccuccaaauguccucugcagagaugccccacaccgaaacaguuucgccucuuccaucaagcauggaccuguugauucaggauagucccgacuccucuacuagcccuaaagggaagcagccaacguccgccgagaaaucaguggcgaagaaagaggauaagguaccggugaagaaacagaagaccagaacagucuuuaguagcacucaauuaugcgugcugaaugacagguuccagcggcagaaauaucuaucucuccagcaaaugcaggaacuguccaacauacuuaaucugucauacaagcagguuaaaaccugguuucagaaccaacgcaugaaaagcaagcgauggcagaaaaauaacuggcccaagaauaguaacggagugacacagaaggcuucugccccuaccuauccauccuuguacagcucguaucaucaagguugucucgucaaucccacuggcaaccugccuauguggucuaaucagacauggaacaauuccaccuggucaaaccagacgcagaauauccaaaguuggagcaaccacuccuggaacacucagaccuggugcacacagucuuggaauaaccaggcauggaauagcccauucuacaacuguggggaggaaucacugcaaaguugcaugcaguuucagcccaauuccccggccagcgaucucgaggcugcauuagaggccgcuggagaaggccugaacgugauucagcaaacuacccguuauuucucuacaccucagaccauggacuuguuucuuaauuacucaaugaacaugcagcccgaggauguauga

SEQ ID NO: 9984 - RNA, 918 nt, Artificial Sequence
  derived and/or modified sequence opt4 from Nanog__Homo_sapiens__AAP49529
augagcguggaccccgccugcccccagagccugcccugcuucgaggccagcgacugcaaggagagcagccccaugcccgugaucugcggccccgaggagaacuaccccagccugcagaugagcagcgccgagaugccccacaccgagaccgugagcccccugcccagcagcauggaccugcugauccaggacagccccgacagcagcaccagccccaagggcaagcagcccaccagcgccgagaagagcguggccaagaaggaggacaaggugcccgugaagaagcagaagaccagaaccguguucagcagcacccagcugugcgugcugaacgacagauuccagagacagaaguaccugagccugcagcagaugcaggagcugagcaacauccugaaccugagcuacaagcaggugaagaccugguuccagaaccagagaaugaagagcaagagauggcagaagaacaacuggcccaagaacagcaacggcgugacccagaaggccagcgcccccaccuaccccagccuguacagcagcuaccaccagggcugccuggugaaccccaccggcaaccugcccauguggagcaaccagaccuggaacaacagcaccuggagcaaccagacccagaacauccagagcuggagcaaccacagcuggaacacccagaccuggugcacccagagcuggaacaaccaggccuggaacagccccuucuacaacugcggcgaggagagccugcagagcugcaugcaguuccagcccaacagccccgccagcgaccuggaggccgcccuggaggccgccggcgagggccugaacgugauccagcagaccaccagauacuucagcaccccccagaccauggaccuguuccugaacuacagcaugaacaugcagcccgaggacguguga

SEQ ID NO: 9985 - RNA, 918 nt, Artificial Sequence
  derived and/or modified sequence opt5 from Nanog__Homo_sapiens__AAP49529
augagcguggaccccgccugcccucagucccugccguguuucgaggcuucugauugcaaggaaagcucccccaugccugucaucuguggccccgaggaaaacuacccuucucuccaaaugagcuccgccgagaugccccacaccgaaacaguuucuccucugccgagcuccauggaccuucugauucaggauagccccgacucuuccacgagcccuaaagggaagcagcccaccucugcggagaaauccguggcuaagaaagaggauaaggugccugucaagaaacagaagacaagaaccguguuuagcucuacacaacucugcguucugaaugaccgguuccagcgccagaaauaucuuucccugcagcaaaugcaggaacucagcaacauccugaaucuguccuacaaacaggugaagaccugguuucagaaccaaagaaugaagucuaagcgguggcagaaaaauaacuggcccaagaauagcaacggagucacacagaaagccuccgccccgaccuauccuagccucuacucuuccuaucaucaaggcugucuggugaaucccacggggaaccuuccuauguggagcaaucagaccuggaacaauucuacauggagcaaccagacccagaauauucaauccuggucuaaccacagcuggaacacacagaccuggugcacgcaguccuggaauaaccaggcuuggaauagccccuucuacaacuguggagaggaaucucugcaauccugcaugcaguuucagcccaauagcccugccucugaucucgaggcugcccuggaggcggccggcgaagggcuuaacguuauccagcaaacaacccgcuauuucuccacaccgcagaccauggaccuguuucucaauuacagcaugaacaugcagcccgaggauguguga

SEQ ID NO: 9986 - RNA, 918 nt, Artificial Sequence
  derived and/or modified sequence opt6 from Nanog__Homo_sapiens__AAP49529
augucagucgauccagcaugcccacaaucccucccaugcuucgaagcaucagauugcaaagaaucaucuccuaugcccguaauaugcggacccgaagaaaauuacccaucacuacaaaugucaucagcagaaaugccacacacagaaacaguaucaccucucccaucaucaauggaccuauuaauacaagacucaccagacucaucaacaucaccaaaaggaaaacaaccuacaucugcagaaaaaucaguagcaaaaaaagaagacaaaguaccaguaaaaaaacaaaaaacaagaacaguauucuccucaacccaacuaugcguacucaaugacagauuccaaagacaaaaauaccuaucacuacaacaaaugcaagaacuaucaaacauacucaaccuaucuuacaaacaaguaaaaacaugguuccaaaaccaacgaaugaaaucaaaaagauggcaaaaaaacaacuggccaaaaaacucuaacggaguaacucaaaaagcaucagcaccaaccuacccaucccuauacucaucuuaccaccaaggaugccuaguaaacccaacaggaaaccuaccaauguggucaaaccaaacauggaacaauucaacauggucaaaccaaacacaaaacauacaauccugguccaaccauucauggaacacacaaacauggugcacacaauccuggaacaaucaagcauggaacucaccauucuacaacugcggagaagaauccuuacaauccugcaugcaauuccaaccaaacuccccugcauccgacuuagaagcagcauuagaagcagcaggcgaaggauuaaacguaauacaacaaacuacaagauacuucucaacaccacaaacaauggaccuauuccuaaauuacucaaugaacaugcaaccagaagacgucuaa

SEQ ID NO: 9987 - protein, 464 aa, Artificial Sequence
  N-myc__Homo_sapiens__P04198
MPSCSTSTMPGMICKNPDLEFDSLQPCFYPDEDDFYFGGPDSTPPGEDIWKKFELLPTPPLSPSRGFAEHSSEPPSWVTEMLLENELWGSPAEEDAFGLGGLGGLTPNPVILQDCMWSGFSAREKLERAVSEKLQHGRGPPTAGSTAQSPGAGAASPAGRGHGGAAGAGRAGAALPAELAHPAAECVDPAVVFPFPVNKREPAPVPAAPASAPAAGPAVASGAGIAAPAGAPGVAPPRPGGRQTSGGDHKALSTSGEDTLSDSDDEDDEEEDEEEEIDVVTVEKRRSSSNTKAVTTFTITVRPKNAALGPGRAQSSELILKRCLPIHQQHNYAAPSPYVESEDAPPQKKIKSEASPRPLKSVIPPKAKSLSPRNSDSEDSERRRNHNILERQRRNDLRSSFLTLRDHVPELVKNEKAAKVVILKKATEYVHSLQAEEHQLLLEKEKLQARQQQLLKKIEHARTC

SEQ ID NO: 9988 - RNA, 1395 nt, Artificial Sequence
  N-myc__Homo_sapiens__AAH02712
augccgagcugcuccacguccaccaugccgggcaugaucugcaagaacccagaccucgaguuugacucgcuacagcccugcuucuacccggacgaagaugacuucuacuucggcggccccgacucgacccccccgggggaggacaucuggaagaaguuugagcugcugcccacgcccccgcugucgcccagccguggcuucgcggagcacagcuccgagcccccgagcugggucacggagaugcugcuugagaacgagcuguggggcagcccggccgaggaggacgcguucggccuggggggacuggguggccucacccccaacccggucauccuccaggacugcauguggagcggcuucuccgcccgcgagaagcuggagcgcgccgugagcgagaagcugcagcacggccgcgggccgccaaccgccgguuccaccgcccaguccccgggagccggcgccgccagcccugcgggucgcgggcacggcggggcugcgggagccggccgcgccggggccgcccugcccgccgagcucgcccacccggccgccgagugcguggaucccgccguggucuuccccuuucccgugaacaagcgcgagccagcgcccgugcccgcagccccggccagugccccggcggcgggcccugcggucgccucgggggcggguauugccgccccagccggggccccgggggucgccccuccgcgcccaggcggccgccagaccagcggcggcgaccacaaggcccucaguaccuccggagaggacacccugagcgauucagaugaugaagaugaugaagaggaagaugaagaggaagaaaucgacguggucacuguggagaagcggcguuccuccuccaacaccaaggcugucaccacauucaccaucacugugcgucccaagaacgcagcccugggucccgggagggcucaguccagcgagcugauccucaaacgaugccuucccauccaccagcagcacaacuaugccgcccccucucccuacguggagagugaggaugcacccccacagaagaagauaaagagcgaggcguccccacguccgcucaagagugucauccccccaaaggcuaagagcuugagcccccgaaacucugacucggaggacagugagcgucgcagaaaccacaacauccuggagcgccagcgccgcaacgaccuucgguccagcuuucucacgcucagggaccacgugccggaguugguaaagaaugagaaggccgccaagguggucauuuugaaaaaggccacugaguauguccacucccuccaggccgaggagcaccagcuuuugcuggaaaaggaaaaauugcaggcaagacagcagcaguugcuaaagaaaauugaacacgcucggacuugcuag

SEQ ID NO: 9989 - RNA, 1395 nt, Artificial Sequence
  derived and/or modified sequence opt1 from N-myc__Homo_sapiens__AAH02712
augcccagcugcuccaccagcaccaugccgggcaugaucugcaagaaccccgaccuggaguucgacucccuccagcccugcuucuaccccgacgaggacgacuucuacuucgggggcccggacagcacgccgcccggggaggacaucuggaagaaguucgagcugcugcccaccccgccccucucccccagccgcggcuucgccgagcacuccagcgagcccccguccugggugaccgagaugcugcuggagaacgagcucugggggagccccgccgaggaggacgcguucggccugggcgggcugggcgggcucacccccaaccccgucauccugcaggacugcaugugguccggcuucagcgcccgcgagaagcuggagcgcgccguguccgagaagcuccagcacgggcggggcccgcccacggccggcagcaccgcccagucccccggggcgggcgccgccagccccgccgggcgcggccacggcggggcggccggcgccgggcgggccggcgccgcgcugccggccgagcuggcccaccccgccgccgagugcguggaccccgcggucguguuccccuucccggugaacaagcgcgagcccgcccccguccccgccgccccggccuccgcgcccgccgccgggcccgccguggccagcggcgcgggcaucgccgccccggccggggcgcccggcguggccccgccccggcccgggggccgccagaccuccgggggcgaccacaaggcccucagcaccagcggcgaggacacgcuguccgacagcgacgacgaggacgacgaggaggaggacgaggaggaggagaucgacgucgugaccguggagaagcggcgcuccagcuccaacaccaaggccgucaccacguucaccaucaccgugcggcccaagaacgccgcgcuggggcccggccgcgcccagagcuccgagcucauccugaagcggugccugcccauccaccagcagcacaacuacgccgcccccagccccuacguggaguccgaggacgccccgccccagaagaagaucaagagcgaggcgagcccccgcccccucaaguccgucaucccgcccaaggccaagucccugagcccccggaacuccgacagcgaggacuccgagcgccggcgcaaccacaacauccuggagcggcagcgccggaacgaccuccgcagcuccuuccugacccugcgcgaccacgugcccgagcucgugaagaacgagaaggccgccaaggucgugauccugaagaaggccacggaguacgugcacagccugcaggcggaggagcaccagcuccugcuggagaaggagaagcuccaggcccggcagcagcagcugcugaagaagaucgagcacgcccggaccugcuga

SEQ ID NO: 9990 - RNA, 1395 nt, Artificial Sequence
  derived and/or modified sequence opt2 from N-myc__Homo_sapiens__AAH02712
augcccuccugcuccaccuccaccaugcccggcaugaucugcaagaaccccgaccucgaguucgacucccuccagcccugcuucuaccccgacgaggacgacuucuacuucggcggccccgacuccaccccccccggcgaggacaucuggaagaaguucgagcuccuccccacccccccccucucccccucccgcggcuucgccgagcacuccuccgagccccccuccugggucaccgagaugcuccucgagaacgagcucuggggcucccccgccgaggaggacgccuucggccucggcggccucggcggccucacccccaaccccgucauccuccaggacugcaugugguccggcuucuccgcccgcgagaagcucgagcgcgccgucuccgagaagcuccagcacggccgcggcccccccaccgccggcuccaccgcccagucccccggcgccggcgccgccucccccgccggccgcggccacggcggcgccgccggcgccggccgcgccggcgccgcccuccccgccgagcucgcccaccccgccgccgagugcgucgaccccgccgucgucuuccccuuccccgucaacaagcgcgagcccgcccccguccccgccgcccccgccuccgcccccgccgccggccccgccgucgccuccggcgccggcaucgccgcccccgccggcgcccccggcgucgcccccccccgccccggcggccgccagaccuccggcggcgaccacaaggcccucuccaccuccggcgaggacacccucuccgacuccgacgacgaggacgacgaggaggaggacgaggaggaggagaucgacgucgucaccgucgagaagcgccgcuccuccuccaacaccaaggccgucaccaccuucaccaucaccguccgccccaagaacgccgcccucggccccggccgcgcccaguccuccgagcucauccucaagcgcugccuccccauccaccagcagcacaacuacgccgcccccucccccuacgucgaguccgaggacgcccccccccagaagaagaucaaguccgaggccuccccccgcccccucaaguccgucaucccccccaaggccaagucccucuccccccgcaacuccgacuccgaggacuccgagcgccgccgcaaccacaacauccucgagcgccagcgccgcaacgaccuccgcuccuccuuccucacccuccgcgaccacguccccgagcucgucaagaacgagaaggccgccaaggucgucauccucaagaaggccaccgaguacguccacucccuccaggccgaggagcaccagcuccuccucgagaaggagaagcuccaggcccgccagcagcagcuccucaagaagaucgagcacgcccgcaccugcuga

SEQ ID NO: 9991 - RNA, 1395 nt, Artificial Sequence
  derived and/or modified sequence opt3 from N-myc__Homo_sapiens__AAH02712
augcccagcugcuccaccucuacaaugccuggcaugaucuguaagaacccagaccuggaguucgauucacuccagccgugcuuuuaccccgacgaagaugacuucuauuuugggggaccugauaguacuccacccggugaggacauuuggaaaaaguucgaacuucugccuacgccacccuugagcccuuccagaggcuuugccgagcacucuucggaaccaccgucaugggugaccgagauguuacuggagaaugaacuaugggggagccccgcugaggaagaugcauucggacucggcggucuagggggacuuacaccuaacccagucauacugcaagacuguauguggaguggcuuuuccgccagggagaaauuggagcgggcgguuucugaaaagcuccagcauggccgcgggcccccuacugcuggaagcaccgcccaguccccaggugcaggcgccgcuucacccgcagggcgaggacacggcggugccgcuggggccggacgugcgggcgcagcccugccggcugagcuggcccauccugcagcugaaugcguggaucccgccguaguguucccauuuccugucaauaaaagagagcccgcgccagugcccgccgccccugcuagugccccagcugccggcccggcaguugccagcggggcuggaaucgcggcacccgccggugcuccuggcguggccccacccaggccugggggacggcagacaucuggcggugaccacaaggcacucuccaccucaggggaagauacuuuaagcgacagugaugacgaggacgaugaggaagaggacgaagaggaagagauugaugucgugacaguagagaagcgcagaucuuccagcaacaccaaagccguuacgacuuucaccaucacagugaggccaaagaaugcugcccugggccccggacgggcacaaucgucugaacuuauuuugaaacgcugucugccgauccaucagcagcacaacuacgcggcuccuuccccauaugucgagucagaagacgcacccccucagaagaaaauaaagagugaggcaagcccccgaccacuaaaguccgugaucccucccaaagccaagucucucagcccaagaaauucagauagugaagacuccgagaggcggcguaaccacaauauucuggagcgccaaagaaggaacgaucuucggagcucuuuucugacuuugcgagaccaugugccggaacucgucaaaaaugagaaggcugccaaaguugugauccugaagaaagcaaccgaauacguacacucauuacaggcugaggagcaucagcugcuccuugaaaaggagaagcugcaggcccgccaacagcaguugcugaaaaagauugaacacgcgagaacaugcuga

SEQ ID NO: 9992 - RNA, 1395 nt, Artificial Sequence
  derived and/or modified sequence opt4 from N-myc__Homo_sapiens__AAH02712
augcccagcugcagcaccagcaccaugcccggcaugaucugcaagaaccccgaccuggaguucgacagccugcagcccugcuucuaccccgacgaggacgacuucuacuucggcggccccgacagcaccccccccggcgaggacaucuggaagaaguucgagcugcugcccacccccccccugagccccagcagaggcuucgccgagcacagcagcgagccccccagcugggugaccgagaugcugcuggagaacgagcuguggggcagccccgccgaggaggacgccuucggccugggcggccugggcggccugacccccaaccccgugauccugcaggacugcauguggagcggcuucagcgccagagagaagcuggagagagccgugagcgagaagcugcagcacggcagaggcccccccaccgccggcagcaccgcccagagccccggcgccggcgccgccagccccgccggcagaggccacggcggcgccgccggcgccggcagagccggcgccgcccugcccgccgagcuggcccaccccgccgccgagugcguggaccccgccgugguguuccccuuccccgugaacaagagagagcccgcccccgugcccgccgcccccgccagcgcccccgccgccggccccgccguggccagcggcgccggcaucgccgcccccgccggcgcccccggcguggccccccccagacccggcggcagacagaccagcggcggcgaccacaaggcccugagcaccagcggcgaggacacccugagcgacagcgacgacgaggacgacgaggaggaggacgaggaggaggagaucgacguggugaccguggagaagagaagaagcagcagcaacaccaaggccgugaccaccuucaccaucaccgugagacccaagaacgccgcccugggccccggcagagcccagagcagcgagcugauccugaagagaugccugcccauccaccagcagcacaacuacgccgcccccagccccuacguggagagcgaggacgcccccccccagaagaagaucaagagcgaggccagccccagaccccugaagagcgugaucccccccaaggccaagagccugagccccagaaacagcgacagcgaggacagcgagagaagaagaaaccacaacauccuggagagacagagaagaaacgaccugagaagcagcuuccugacccugagagaccacgugcccgagcuggugaagaacgagaaggccgccaagguggugauccugaagaaggccaccgaguacgugcacagccugcaggccgaggagcaccagcugcugcuggagaaggagaagcugcaggccagacagcagcagcugcugaagaagaucgagcacgccagaaccugcuga

SEQ ID NO: 9993 - RNA, 1395 nt, Artificial Sequence
  derived and/or modified sequence opt5 from N-myc__Homo_sapiens__AAH02712
augcccagcugcuccaccucuacaaugccuggcaugaucuguaagaacccggaccuggaguucgauagccuccagcccugcuuuuacccugacgaagaugacuucuauuuugggggacccgauuccacgccucccggcgaggacauuuggaaaaaguucgaacugcuuccuaccccgccccugucuccuagcagaggguuugccgagcacuccucugaacccccuagcugggugacagagaugcuccuggagaaugaacuuuggggaucccccgcugaggaagaugccuucggccucgggggacugggcggccugaccccgaacccugucauccugcaagacuguauguggagcggguuuucugcgcgggagaaacucgagcgcgcuguuuccgaaaagcugcagcauggaagaggacccccuacagccgggagcaccgcccagucucccggagcuggcgccgcuucccccgccgggcggggacacggcggcgcggccggggcuggacgcgccggcgcugcccuuccugcggagcuggcccauccggcugccgaaugcguggaucccgcuguggucuucccuuuucccgugaauaaaagagagccugcccccguuccggccgcuccugcgagcgcccccgcugccgggccugccguggcuucuggagccggcauugcggcucccgccggggccccuggagucgcucccccgcggccuggcggccgccagacauccgggggagaccacaaggcccucagcaccuccggcgaagauacgcugucugacagcgaugacgaggacgaugaggaagaggacgaagaggaagagaucgaugugguuaccguggagaagagacgguccagcucuaacacaaaagcugucaccacauucaccauuacggugcgccccaagaaugccgcgcuugggcccggcagagcccaauccagcgaacugauccucaaacggugucugccuauccaucagcagcacaacuacgcugccccgucucccuauguggagagcgaagacgcuccuccccagaagaaaauuaaguccgaggccucuccucgcccccucaagagcgucaucccucccaaagcgaagucccugagcccgagaaauucugauuccgaagacagcgagcggcgcagaaaccacaauauucuggagcggcaaagacgcaacgaucuucggucuuccuuucugacacucagagaccauguuccugaacuggugaaaaaugagaaggccgcuaaaguggucauccuuaagaaagccaccgaauacgugcacagccugcaggcugaggagcaucagcuccugcuggaaaaggagaagcuccaggcccgccaacagcagcugcuuaaaaagauugaacacgcccggacaugcuga

SEQ ID NO: 9994 - RNA, 1395 nt, Artificial Sequence
  derived and/or modified sequence opt6 from N-myc__Homo_sapiens__AAH02712
augccaucauguucaacaagcacaaugccaggaaugauaugcaaaaauccugaucuagaauucgacaguuuacaaccauguuucuauccagaugaagaugauuuuuacuucggcggaccagacucaacaccaccaggagaagauauauggaaaaaauuugaauuacuacccacccccccauuaucaccgaguagaggauucgcagaacauucaucagaaccaccaaguuggguaacagaaauguuacucgaaaacgaauuauggggaaguccugcggaagaagaugcuuuuggacuaggcggacuaggaggauuaacaccaaauccaguuauauuacaagacuguauguggucaggauucuccgcacgcgaaaaauuagaaagagcaguaucagaaaaacuacaacauggcagaggaccaccaacagcagguucaacagcucaaucucccggagcaggcgcagcaaguccagcaggaagaggacauggaggagccgcaggagcaggacgcgccggagcugcacuaccagcagaauuagcucauccagcagcagaauguguagacccagcaguaguuuuuccuuuuccuguaaauaaaagagaaccagccccaguaccagcagcuccagccucagcaccagcagcaggucccgccguagcaucaggagcaggaauagcagcaccagcaggagcaccuggaguggcaccuccacgaccagguggacgacaaacaagcgguggagaucacaaagcacuuucaaccucaggagaagauacauuaagugauagugaugaugaagacgaugaagaagaagacgaagaagaagaaauagacguagucacugucgaaaaaagacgaucaucaucaaacacaaaagcuguaacaacuuuuacgauuacaguaagaccaaaaaacgccgcacuagguccaggaagagcacaaucaucugaauuaauacuaaaaagaugucuaccaauucaucaacaacacaauuaugcagcaccaucaccauauguugaaagcgaagaugcaccaccacaaaaaaagauuaaaucugaagcaucaccaagaccauuaaaaaguguaauaccaccaaaagcaaaaucguuauccccucgaaacucagauucagaagauucagaacgaagaagaaaucauaacauucuagaaagacaacgaagaaaugauuuaagaaguucauuccuuacacuaagagaucauguuccagaacuaguaaaaaaugaaaaagcagcaaaaguuguaauucuaaaaaaagcaacagaauauguacauuccuuacaagcugaagaacaucaauuauuacuugaaaaagaaaaauuacaagcaagacaacaacaacuacuaaaaaaaauagaacacgcacgcacaugcuaa

SEQ ID NO: 9995 - protein, 112 aa, Artificial Sequence
  N-myc__Homo_sapiens__Q9H224
MRGAPGNCVGAEQALARRKRAQTVAIRGHPRPPGPPGDTRAESPPDPLQSAGVLEVGAGPRLPRPPREGSTPGIKTNGAERSPQSPAGRRADAELLHVHHAGHDLQEPRPRV

SEQ ID NO: 9996 - RNA, 339 nt, Artificial Sequence
  N-myc__Homo_sapiens__AAG40001
augcggggggcuccugggaacuguguuggagccgagcaagcgcuagccaggcgcaagcgcgcacagacuguagccauccgaggacacccccgcccccccggcccacccggagacacccgcgcagaaucgccuccggauccccugcagucggcgggaguguuggaggucggcgccggcccccgccuuccgcgccccccacgggaaggaagcacccccgguauuaaaacgaacggggcggaaagaagcccucagucgccggccgggaggcgagccgaugccgagcugcuccacguccaccaugccgggcaugaucugcaagaacccagaccucgaguuuga

SEQ ID NO: 9997 - RNA, 339 nt, Artificial Sequence
  derived and/or modified sequence opt1 from N-myc__Homo_sapiens__AAG40001
augcgcggcgcccccgggaacugcgugggcgccgagcaggcgcuggcccggcgcaagcgggcccagaccgucgccauccgcgggcacccgcggccgcccggcccgcccggggacacccgcgccgagagcccgcccgacccccuccaguccgcgggcgugcuggaggugggcgccgggccccggcugccccgcccgccccgggagggcagcacgcccgggaucaagaccaacggcgccgagcgcagcccccagucccccgccgggcggcgcgcggacgccgagcuccugcacguccaccacgccggccacgaccugcaggagccccggccccgcguguga

SEQ ID NO: 9998 - RNA, 339 nt, Artificial Sequence
  derived and/or modified sequence opt2 from N-myc__Homo_sapiens__AAG40001
augcgcggcgcccccggcaacugcgucggcgccgagcaggcccucgcccgccgcaagcgcgcccagaccgucgccauccgcggccacccccgcccccccggcccccccggcgacacccgcgccgaguccccccccgacccccuccaguccgccggcguccucgaggucggcgccggcccccgccucccccgccccccccgcgagggcuccacccccggcaucaagaccaacggcgccgagcgcuccccccagucccccgccggccgccgcgccgacgccgagcuccuccacguccaccacgccggccacgaccuccaggagccccgcccccgcgucuga

SEQ ID NO: 9999 - RNA, 339 nt, Artificial Sequence
  derived and/or modified sequence opt3 from N-myc__Homo_sapiens__AAG40001
augagaggcgcccccgggaacugcgugggagcugagcaggcacuggccaggcggaagcgcgcgcaaaccgucgcuauccgaggucacccucguccaccggggcccccuggcgacacaagagccgaaagcccacccgauccucuccaguccgcaggaguucuugaggugggcgccgguccaaggcugccccggccuccacgcgaagggucuacuccgggaauuaaaacgaauggcgcugagagaucaccccagaguccugcaggcaggcgggccgacgcugaauuguuacauguacaccaugccgggcacgaucugcaggagccacgcccccgaguguga

SEQ ID NO: 10000 - RNA, 339 nt, Artificial Sequence
  derived and/or modified sequence opt4 from N-myc__Homo_sapiens__AAG40001
augagaggcgcccccggcaacugcgugggcgccgagcaggcccuggccagaagaaagagagcccagaccguggccaucagaggccaccccagaccccccggcccccccggcgacaccagagccgagagcccccccgacccccugcagagcgccggcgugcuggaggugggcgccggccccagacugcccagaccccccagagagggcagcacccccggcaucaagaccaacggcgccgagagaagcccccagagccccgccggcagaagagccgacgccgagcugcugcacgugcaccacgccggccacgaccugcaggagcccagacccagaguguga

SEQ ID NO: 10001 - RNA, 339 nt, Artificial Sequence
  derived and/or modified sequence opt5 from N-myc__Homo_sapiens__AAG40001
augagaggcgcccccgggaacugcgugggagcugagcaggcccuggcgcggcgcaagagagcucaaaccgucgccauccggggccacccucgcccgcccgggccucccggagacacaagagccgaaagcccucccgauccucuccaguccgcuggcguucuggaggugggggccggaccgcggcuuccccgcccucccagagaaggcucuacgccuggcauuaaaaccaauggggcugagcggagcccccaguccccggccggacgcagagcggacgccgaacugcuccaugugcaccaugcuggccacgaucugcaggagccucggccccgcgucuga

SEQ ID NO: 10002 - RNA, 339 nt, Artificial Sequence
  derived and/or modified sequence opt6 from N-myc__Homo_sapiens__AAG40001
augagaggagcaccaggaaacuguguaggagcagaacaagcauuagcaagaagaaaaagagcacaaacaguagcaauaagaggacacccaagaccaccaggaccaccaggagauacaagagcagaaucaccuccagauccauuacaaucagcaggaguauuagaaguaggagcaggaccaagauuaccaagaccaccaagagaaggaucaacaccaggaauaaaaacaaacggagcagaaagaucaccacaaucaccagcaggaagaagagcagaugcagaacuauuacacguacaccaugcaggacacgauuuacaagaaccaagaccaagaguauaa

SEQ ID NO: 10003 - protein, 86 aa, Artificial Sequence
  N-myc__Homo_sapiens__V9H1L1
MRGAPGNCVGAEQALARRKRAQTVAIRGHPRPPGPPGDTRAESPPDPLQSAGGKEQGLQTARRPGKRRAPGQGKPWTGLRRAHRAP

SEQ ID NO: 10004 - RNA, 261 nt, Artificial Sequence
  N-myc__Homo_sapiens__CAA68677
augcggggggcuccugggaacuguguuggagccgagcaagcgcuagccaggcgcaagcgcgcacagacuguagccauccgaggacacccccgcccccccggcccacccggagacacccgcgcagaaucgccuccggauccccugcagucggcgggagguaaggagcagggcuugcaaaccgcccggcgcccagggaagcgacgagcgccggggcaaggcaagcccuggacgggauugcgacgugcgcaccgggcgcccuaa

SEQ ID NO: 10005 - RNA, 261 nt, Artificial Sequence
  derived and/or modified sequence opt1 from N-myc__Homo_sapiens__CAA68677
augcgcggcgcccccgggaacugcgugggcgccgagcaggcgcuggcccggcgcaagcgggcccagaccgucgccauccgcgggcacccccggccgcccggcccgcccggggacacccgcgccgagagcccgcccgacccccuccaguccgcgggcggcaaggagcaggggcugcagacggcccggcgccccggcaagcggcgcgcccccgggcagggcaagcccuggaccgggcugcggcgcgcccaccgggcgcccuga

SEQ ID NO: 10006 - RNA, 261 nt, Artificial Sequence
  derived and/or modified sequence opt2 from N-myc__Homo_sapiens__CAA68677
augcgcggcgcccccggcaacugcgucggcgccgagcaggcccucgcccgccgcaagcgcgcccagaccgucgccauccgcggccacccccgcccccccggcccccccggcgacacccgcgccgaguccccccccgacccccuccaguccgccggcggcaaggagcagggccuccagaccgcccgccgccccggcaagcgccgcgcccccggccagggcaagcccuggaccggccuccgccgcgcccaccgcgcccccuga

SEQ ID NO: 10007 - RNA, 261 nt, Artificial Sequence
  derived and/or modified sequence opt3 from N-myc__Homo_sapiens__CAA68677
augagaggcgcccccgggaacugcgugggagcugagcaggcacuggccaggcggaagcgcgcgcaaaccgucgcuauccgaggucacccucguccaccggggcccccuggcgacacaagagccgaaagcccacccgauccucuccaguccgcaggaggcaaagagcagggucuucagacugccaggcggccagggaagcgcagagcucccggacaaggcaaaccuuggacgggccugaggcgggcacaucgcgccccauga

SEQ ID NO: 10008 - RNA, 261 nt, Artificial Sequence
  derived and/or modified sequence opt4 from N-myc__Homo_sapiens__CAA68677
augagaggcgcccccggcaacugcgugggcgccgagcaggcccuggccagaagaaagagagcccagaccguggccaucagaggccaccccagaccccccggcccccccggcgacaccagagccgagagcccccccgacccccugcagagcgccggcggcaaggagcagggccugcagaccgccagaagacccggcaagagaagagcccccggccagggcaagcccuggaccggccugagaagagcccacagagcccccuga

SEQ ID NO: 10009 - RNA, 261 nt, Artificial Sequence
  derived and/or modified sequence opt5 from N-myc__Homo_sapiens__CAA68677
augagaggcgcccccgggaacugcgugggagcugagcaggcccuggcgcggcgcaagagagcucaaaccgucgccauccggggccacccucgcccgcccgggccucccggagacacaagagccgaaagcccucccgauccucuccaguccgcuggcgggaaagagcagggacugcagacggcccggcgcccgggcaagagacgggcucccggccaagggaaaccuuggaccggacuucgcagagcccaucgggcgcccuga

SEQ ID NO: 10010 - RNA, 261 nt, Artificial Sequence
  derived and/or modified sequence opt6 from N-myc__Homo_sapiens__CAA68677
augagaggagcaccaggaaauugcguaggagcagaacaagcauuagcaagaagaaaaagagcacaaacaguagcaauaagaggacauccaagaccaccaggaccaccaggagacacaagagcagaaucaccaccagacccacuacaaagugcaggaggaaaagaacaaggacuacaaacagcaagaagaccaggaaaaagaagagcaccaggacaaggaaaaccauggacaggauuaagaagagcacauagagcaccauaa

SEQ ID NO: 10011 - protein, 360 aa, Artificial Sequence
  Oct3__Homo_sapiens__Q01860
MAGHLASDFAFSPPPGGGGDGPGGPEPGWVDPRTWLSFQGPPGGPGIGPGVGPGSEVWGIPPCPPPYEFCGGMAYCGPQVGVGLVPQGGLETSQPEGEAGVGVESNSDGASPEPCTVTPGAVKLEKEKLEQNPEESQDIKALQKELEQFAKLLKQKRITLGYTQADVGLTLGVLFGKVFSQTTICRFEALQLSFKNMCKLRPLLQKWVEEADNNENLQEICKAETLVQARKRKRTSIENRVRGNLENLFLQCPKPTLQQISHIAQQLGLEKDVVRVWFCNRRQKGKRSSSDYAQREDFEAAGSPFSGGPVSFPLAPGPHFGTPGYGSPHFTALYSSVPFPEGEAFPPVSVTTLGSPMHSN

SEQ ID NO: 10012 - RNA, 1083 nt, Artificial Sequence
  Oct3__Homo_sapiens__AAI17436
auggcgggacaccuggcuucggauuucgccuucucgcccccuccaggugguggaggugaugggccaggggggccggagccgggcuggguugauccucggaccuggcuaagcuuccaaggcccuccuggagggccaggaaucgggccggggguugggccaggcucugaggugugggggauucccccaugccccccgccguaugaguucuguggggggauggcguacugugggccccagguuggaguggggcuagugccccaaggcggcuuggagaccucucagccugagggcgaagcaggagucgggguggagagcaacuccgauggggccuccccggagcccugcaccgucaccccuggugccgugaagcuggagaaggagaagcuggagcaaaacccggaggagucccaggacaucaaagcucugcagaaagaacucgagcaauuugccaagcuccugaagcagaagaggaucacccugggauauacacaggccgauguggggcucacccuggggguucuauuugggaagguauucagccaaacgaccaucugccgcuuugaggcucugcagcuuagcuucaagaacauguguaagcugcggcccuugcugcagaaguggguggaggaagcugacaacaaugaaaaucuucaggagauaugcaaagcagaaacccucgugcaggcccgaaagagaaagcgaaccaguaucgagaaccgagugagaggcaaccuggagaauuuguuccugcagugcccgaaacccacacugcagcagaucagccacaucgcccagcagcuugggcucgagaaggaugugguccgagugugguucuguaaccggcgccagaagggcaagcgaucaagcagcgacuaugcacaacgagaggauuuugaggcugcugggucuccuuucucagggggaccaguguccuuuccucuggccccagggccccauuuugguaccccaggcuaugggagcccucacuucacugcacuguacuccucggucccuuucccugagggggaagccuuucccccugucuccgucaccacucugggcucucccaugcauucaaacuga

SEQ ID NO: 10013 - RNA, 1083 nt, Artificial Sequence
  derived and/or modified sequence opt1 from Oct3__Homo_sapiens__AAI17436
auggccggccaccuggccagcgacuucgcguucuccccgccgcccgggggcgggggcgacgggcccggcggccccgagccgggguggguggacccccgcaccuggcucagcuuccagggcccgcccgggggccccgggaucggccccggcgucgggcccggcuccgaggugugggggaucccgcccugcccgccgcccuacgaguucugcggcggcauggccuacugcgggccccaggugggcgucgggcuggugccccagggcgggcuggagaccagccagcccgagggcgaggccggcgugggggucgaguccaacagcgacggcgccucccccgagcccugcacggugacccccggggccgugaagcucgagaaggagaagcuggagcagaaccccgaggagagccaggacaucaaggcgcugcagaaggagcucgagcaguucgccaagcugcugaagcagaagcggaucacccucggcuacacccaggccgacgucgggcugacgcugggcguccucuucggcaagguguucucccagaccaccaucugccgcuucgaggcccugcagcugagcuucaagaacaugugcaagcuccggccccugcugcagaaguggguggaggaggcggacaacaacgagaaccuccaggagaucugcaaggccgagacccuggugcaggcccgcaagcggaagcgcacguccaucgagaaccgggugcgcgggaaccuggagaaccucuuccugcagugccccaagcccacccugcagcagaucagccacaucgcccagcagcucggccuggagaaggacgucgugcgggugugguucugcaaccgccggcagaaggggaagcgcuccagcuccgacuacgcccagcgggaggacuucgaggcggccggcagccccuucuccgggggccccgucagcuucccgcuggcccccggcccccacuucgggaccccgggcuacgggagcccccacuucaccgcccucuacuccagcgugcccuuccccgagggcgaggccuucccgcccguguccgucacgacccugggcagccccaugcacuccaacuga

SEQ ID NO: 10014 - RNA, 1083 nt, Artificial Sequence
  derived and/or modified sequence opt2 from Oct3__Homo_sapiens__AAI17436
auggccggccaccucgccuccgacuucgccuucucccccccccccggcggcggcggcgacggccccggcggccccgagcccggcugggucgacccccgcaccuggcucuccuuccagggcccccccggcggccccggcaucggccccggcgucggccccggcuccgaggucuggggcaucccccccugccccccccccuacgaguucugcggcggcauggccuacugcggcccccaggucggcgucggccucgucccccagggcggccucgagaccucccagcccgagggcgaggccggcgucggcgucgaguccaacuccgacggcgccucccccgagcccugcaccgucacccccggcgccgucaagcucgagaaggagaagcucgagcagaaccccgaggagucccaggacaucaaggcccuccagaaggagcucgagcaguucgccaagcuccucaagcagaagcgcaucacccucggcuacacccaggccgacgucggccucacccucggcguccucuucggcaaggucuucucccagaccaccaucugccgcuucgaggcccuccagcucuccuucaagaacaugugcaagcuccgcccccuccuccagaagugggucgaggaggccgacaacaacgagaaccuccaggagaucugcaaggccgagacccucguccaggcccgcaagcgcaagcgcaccuccaucgagaaccgcguccgcggcaaccucgagaaccucuuccuccagugccccaagcccacccuccagcagaucucccacaucgcccagcagcucggccucgagaaggacgucguccgcgucugguucugcaaccgccgccagaagggcaagcgcuccuccuccgacuacgcccagcgcgaggacuucgaggccgccggcucccccuucuccggcggccccgucuccuucccccucgcccccggcccccacuucggcacccccggcuacggcuccccccacuucaccgcccucuacuccuccguccccuuccccgagggcgaggccuucccccccgucuccgucaccacccucggcucccccaugcacuccaacuga

SEQ ID NO: 10015 - RNA, 1083 nt, Artificial Sequence
  derived and/or modified sequence opt3 from Oct3__Homo_sapiens__AAI17436
auggccggccaccuggcuagcgacuucgcauuuagucccccuccagggggagguggcgaugggccgggaggccccgaaccugguuggguggacccaagaaccuggcucucuuuccaggggcccccuggaggcccaggcaucgggcccggagucgguccuggcucagaaguuugggggauuccaccgugucccccuccauacgaguuuugcggaggcauggccuauugcgguccccaaguggggguaggacuugugccucagggcggccuggaaacaagucagccagagggggaagcgggagucgguguggagagcaacuccgauggcgcuucucccgagccguguacuguuacgccuggggccgugaaguuggaaaaagagaaguuagaacagaaucccgaggagucgcaagacauaaaagcacugcagaaggaacuagagcaguucgccaaacuccugaagcagaagaggaucacccuuggauacacacaagcugaugucggccugacuuugggugugcucuuugggaaaguauucucacagaccacaauuugccgguuugaagcacugcagcugagcuucaagaacauguguaaacuccgcccauuacugcagaaguggguugaggaagccgacaauaacgagaaucuucaagagaucugcaaagcugaaaccuuggugcaggcccgaaagcguaagagaacuuccauugagaacaggguccggggcaaucuggaaaaccuauuucuccaguguccuaaacccacacugcaacagaucucccauauagcgcagcagcuuggacuggagaaggauguggugcgcgucugguucugcaauagaaggcaaaaaggcaagcggucuagcuccgacuaugcacagcgcgaagauuuugaggccgcugggucaccauucaguggaggucccguuagcuuuccuuuggccccaggcccgcacuucgggacccccggauacggcucuccucauuucacggcacucuauuccucagugccauuucccgagggugaggcuuucccuccaguaagcgugacuacccuggggagucccaugcacucuaacuga

SEQ ID NO: 10016 - RNA, 1083 nt, Artificial Sequence
  derived and/or modified sequence opt4 from Oct3__Homo_sapiens__AAI17436
auggccggccaccuggccagcgacuucgccuucagccccccccccggcggcggcggcgacggccccggcggccccgagcccggcuggguggaccccagaaccuggcugagcuuccagggcccccccggcggccccggcaucggccccggcgugggccccggcagcgagguguggggcaucccccccugccccccccccuacgaguucugcggcggcauggccuacugcggcccccaggugggcgugggccuggugccccagggcggccuggagaccagccagcccgagggcgaggccggcgugggcguggagagcaacagcgacggcgccagccccgagcccugcaccgugacccccggcgccgugaagcuggagaaggagaagcuggagcagaaccccgaggagagccaggacaucaaggcccugcagaaggagcuggagcaguucgccaagcugcugaagcagaagagaaucacccugggcuacacccaggccgacgugggccugacccugggcgugcuguucggcaagguguucagccagaccaccaucugcagauucgaggcccugcagcugagcuucaagaacaugugcaagcugagaccccugcugcagaaguggguggaggaggccgacaacaacgagaaccugcaggagaucugcaaggccgagacccuggugcaggccagaaagagaaagagaaccagcaucgagaacagagugagaggcaaccuggagaaccuguuccugcagugccccaagcccacccugcagcagaucagccacaucgcccagcagcugggccuggagaaggacguggugagagugugguucugcaacagaagacagaagggcaagagaagcagcagcgacuacgcccagagagaggacuucgaggccgccggcagccccuucagcggcggccccgugagcuucccccuggcccccggcccccacuucggcacccccggcuacggcagcccccacuucaccgcccuguacagcagcgugcccuuccccgagggcgaggccuucccccccgugagcgugaccacccugggcagccccaugcacagcaacuga

SEQ ID NO: 10017 - RNA, 1083 nt, Artificial Sequence
  derived and/or modified sequence opt5 from Oct3__Homo_sapiens__AAI17436
auggccggccaccuggcuagcgacuucgccuuuuccccgccucccgggggaggcggggauggacccggcgggccugagcccggauggguggacccuagaaccuggcucucuuuccaggggcccccuggcggcccgggaaucggccccggggucggaccuggcagcgaaguuugggggauucccccuugucccccgccuuacgaguuuugcggaggcauggcguauugcggcccccaagugggggugggacuggucccucagggcgggcuugaaacaucccagcccgagggagaagcuggcguggggguugagucuaacagcgauggagccucccccgagccuuguacggugaccccgggcgccgucaagcuggaaaaagagaagcucgaacagaaucccgaggagucucaagacaucaaagcucugcagaaggaacuugagcaguucgccaaacugcucaagcagaagcggauuacacugggcuacacccaagcugauguggggcugacacucggaguucuguuuggcaaaguguucagccagaccacaaucugccgcuuugaagcccuucagcuguccuucaagaacauguguaaacucagaccucugcuucagaagugggucgaggaagcggacaauaacgagaaucugcaagagauuugcaaagccgaaacccucgugcaggcucggaagcgcaagagaacgagcaucgagaaccgggugcgcgggaaucuggaaaaccuguuucuccagugucccaaaccuacccugcaacagaucucucauauugcccagcagcuuggacuggagaaggaugucguuagagugugguucugcaaucggcgccaaaaaggcaagagauccagcucugacuaugcucagcgggaagauuuugaggccgcggggucccccuucagcggcggaccggugucuuuuccucucgcccccggcccucacuucgggacacccggauacggcuccccucauuucaccgcucuguauagcuccguccccuuuccggagggggaagccuucccucccgugucuguuacaacccuuggaagccccaugcacuccaacuga

SEQ ID NO: 10018 - RNA, 1083 nt, Artificial Sequence
  derived and/or modified sequence opt6 from Oct3__Homo_sapiens__AAI17436
auggcaggacaucuagcaucagauuuugcauuuagcccaccaccaggagguggaggagacgguccaggaggaccagaaccaggauggguagauccaagaacaugguuaucguuucaaggaccaccaggcggaccuggaauaggaccaggaguaggcccaggaucagaaguauggggaauaccuccaugcccaccaccauaugaauucuguggaggaauggcauacuguggaccacaaguaggaguagguuuaguaccacaagguggauuagaaaccucacaaccagaaggugaagcaggaguaggaguagaaucaaauucagauggagcaucaccagaaccuuguacaguuacaccaggagcaguuaaacuugaaaaagaaaaauuagaacaaaacccagaagaaucacaagauauaaaagcauuacaaaaagaauuagaacaauucgcaaaauuauugaaacaaaaaagaauaacacucggauacacacaagcagauguaggauuaacuuuaggaguacuauuuggaaaaguauuuagucaaacaacaauauguagauucgaagcauuacaauuauccuuuaaaaauaugugcaaacuaagaccacuacuacaaaaauggguagaagaagcagauaauaaugaaaaccuucaagaaauauguaaagcagaaacacuaguacaagcaagaaaaagaaaaagaacaucaauagaaaauagaguaagagguaaucuagaaaauuuauuucuucaaugucccaaaccaacacuacaacaaauaucacacauagcacaacaauuaggauuagaaaaagauguaguaagaguaugguuuuguaaucgaagacaaaaaggaaaaagaucaucaucagauuaugcacaaagggaagauuucgaagcagcaggaaguccauuuaguggaggaccagucucauuuccauuagcacccgguccacauuuuggaacaccaggauauggaucaccacauuuuacagcuuuauauucaaguguaccauuuccugaaggugaagcuuucccaccaguaucaguuacaacauuaggaucaccaaugcauucaaacuaa

SEQ ID NO: 10019 - protein, 233 aa, Artificial Sequence [sequence omitted]

SEQ ID NO: 10020 - RNA, 702 nt, Artificial Sequence
  Sox15__Homo_sapiens__AAH00985
auggcgcuaccaggcuccucacaggaccaggccuggagccuggagccuccggcugccacggcugcugccuccucaucuucgggaccccaggagcgggagggcgcugggagccccgcggcccccgggacgcugccccuggagaaggugaagcggccgaugaacgcguucaugguguggagcuccgcucagcgccgccagauggcgcagcagaaccccaagaugcacaacuccgagaucuccaagcgccugggcgcgcaguggaagcugcuggacgaggacgagaagcggcccuucguggaggaggccaagcggcuccgcgcccgacaccugcgcgacuaccccgacuacaaguaccggccucggcgcaaggccaagagcucgggcgccggaccuucccgcugcggacagggaagaggcaaccuggccagcggcggcccgcucugggggccgggguacgcgaccacccaaccgagcagaggcuuuggguacagaccccccagcuacucgacagccuaccugccuggcagcuauggcucuucccacugcaaacuggaagcccccucaccgugcucccucccucagagugacccuaggcuccagggggaacugcugcccaccuauacccacuaccugcccccuggcucucccacuccauacaacccuccccuugcuggugcccccaugccccuaacccaccucuaa

SEQ ID NO: 10021 - RNA, 702 nt, Artificial Sequence
  derived and/or modified sequence opt1 from Sox15__Homo_sapiens__AAH00985
auggcccugcccggcagcucccaggaccaggccuggagccucgagccgcccgcggccaccgccgccgccuccagcuccagcgggccccaggagcgcgagggcgcggggucccccgccgccccgggcacccugccccuggagaaggugaagcggcccaugaacgccuucauggucuggagcuccgcgcagcgccggcagauggcccagcagaaccccaagaugcacaacagcgagaucuccaagcgccucggggcccaguggaagcugcuggacgaggacgagaagcggccguucguggaggaggccaagcgccuccgggcccgccaccuccgggacuaccccgacuacaaguaccgcccccggcgcaaggccaagagcuccggcgcgggccccagccggugcgggcagggccgcgggaaccuggccuccggcgggccgcuguggggccccggcuacgccacgacccagcccagccggggguucggcuaccggcccccguccuacagcaccgccuaccugcccggguccuacggcagcagccacugcaagcuggaggcgcccucccccugcagccucccgcaguccgacccccgccugcagggcgagcugcuccccaccuacacgcacuaccugcccccggggagccccacccccuacaacccgccccuggccggcgcccccaugccccucacccaccuguga

SEQ ID NO: 10022 - RNA, 702 nt, Artificial Sequence
  derived and/or modified sequence opt2 from Sox15__Homo_sapiens__AAH00985
auggcccuccccggcuccucccaggaccaggccuggucccucgagccccccgccgccaccgccgccgccuccuccuccuccggcccccaggagcgcgagggcgccggcucccccgccgcccccggcacccucccccucgagaaggucaagcgccccaugaacgccuucauggucugguccuccgcccagcgccgccagauggcccagcagaaccccaagaugcacaacuccgagaucuccaagcgccucggcgcccaguggaagcuccucgacgaggacgagaagcgccccuucgucgaggaggccaagcgccuccgcgcccgccaccuccgcgacuaccccgacuacaaguaccgcccccgccgcaaggccaaguccuccggcgccggccccucccgcugcggccagggccgcggcaaccucgccuccggcggcccccucuggggccccggcuacgccaccacccagcccucccgcggcuucggcuaccgcccccccuccuacuccaccgccuaccuccccggcuccuacggcuccucccacugcaagcucgaggcccccucccccugcucccucccccaguccgacccccgccuccagggcgagcuccuccccaccuacacccacuaccucccccccggcucccccacccccuacaaccccccccucgccggcgcccccaugccccucacccaccucuga

SEQ ID NO: 10023 - RNA, 702 nt, Artificial Sequence
  derived and/or modified sequence opt3 from Sox15__Homo_sapiens__AAH00985
auggcccugcccggcagcucccaggaccaggcuuggucucucgagccuccagcagccaccgcggcugccucaaguagcuccgggccgcaagaaagagagggagcagguucucccgccgcuccuggcacacuuccacuggaaaaggugaaaaggcccaugaacgcauucauggucuggucgucagcccagcggcgccagauggcucaacagaacccuaagaugcacaacagcgagaucaguaaacgauugggggcccaguggaaguuacuggaugaagacgagaaacguccauuuguugaggaagcgaagagacuaagggcacggcaucuccgcgauuaccccgacuauaaguacagaccuaggcggaaagccaaguccucuggagcuggcccaagccgcugcggucaggggcgaggaaaucuggccuccggcggcccgcuuugggggcccggauaugcaacuacgcaaccuucaagagguuucggcuacaggccacccaguuauagcaccgcuuaccugccugggucuuauggauccucacacuguaaauuggaggccccaagccccugcagucucccgcagucugauccucggcugcagggcgaacugcuccccacauacacucauuacuuaccaccugguucccccaccccauauaaucccccucuggcgggggccccaaugccgcuuacacacuuguga

SEQ ID NO: 10024 - RNA, 702 nt, Artificial Sequence
  derived and/or modified sequence opt4 from Sox15__Homo_sapiens__AAH00985
auggcccugcccggcagcagccaggaccaggccuggagccuggagccccccgccgccaccgccgccgccagcagcagcagcggcccccaggagagagagggcgccggcagccccgccgcccccggcacccugccccuggagaaggugaagagacccaugaacgccuucaugguguggagcagcgcccagagaagacagauggcccagcagaaccccaagaugcacaacagcgagaucagcaagagacugggcgcccaguggaagcugcuggacgaggacgagaagagacccuucguggaggaggccaagagacugagagccagacaccugagagacuaccccgacuacaaguacagacccagaagaaaggccaagagcagcggcgccggccccagcagaugcggccagggcagaggcaaccuggccagcggcggcccccuguggggccccggcuacgccaccacccagcccagcagaggcuucggcuacagaccccccagcuacagcaccgccuaccugcccggcagcuacggcagcagccacugcaagcuggaggcccccagccccugcagccugccccagagcgaccccagacugcagggcgagcugcugcccaccuacacccacuaccugccccccggcagccccacccccuacaaccccccccuggccggcgcccccaugccccugacccaccuguga

SEQ ID NO: 10025 - RNA, 702 nt, Artificial Sequence
  derived and/or modified sequence opt5 from Sox15__Homo_sapiens__AAH00985
auggcccugcccggcagcucccaggaccaggcuuggucucucgagccuccggccgcgaccgcugccgccagcuccucuagcgggccccaagaaagagagggagcuggcuccccugccgcucccgggacacugccucuugaaaaggugaaacggcccaugaacgccuucauggucuggucuagcgcgcagcgcagacagauggcccaacagaauccuaagaugcacaacuccgagaucagcaaacggcugggagcucaguggaagcuccuggaugaagacgagaaacgcccguuuguugaggaagccaagagacuucgggcucgccaucugagagauuaccccgacuauaaguaccggccucgcagaaaagccaagucuuccggcgcggggcccagccggugcggacagggccgcggcaaucucgccucugggggaccucuguggggccccggguaugcuacgacccaaccguccagaggauucggcuaccggccucccagcuauucuacagccuaccugccuggguccuauggaagcucccacuguaaacucgaggcucccucucccugcagccugccucaguccgauccgcgccuucagggcgaacugcuccccaccuacacacauuaccugccucccggcagcccuacccccuauaacccgccucuugccggggcccccaugccucugacacaccucuga

SEQ ID NO: 10026 - RNA, 702 nt, Artificial Sequence
  derived and/or modified sequence opt6 from Sox15__Homo_sapiens__AAH00985
auggcauuaccaggaucaucucaagaccaagcauggucauuagaaccaccagcagcaacagcugcagcaucaaguagcucaggaccacaagaaagagaaggagcaggcucacccgcagcaccaggaacauuaccacuagaaaaaguaaaaagacccaugaacgcauucauggucuggagcucagcacaaagaagacaaauggcccaacaaaauccaaaaaugcacaauucagaaauauccaaaagauuaggagcacaauggaaauuauuagaugaagaugaaaaaagaccauuuguagaagaagcaaaaagacuuagagccagacaccuaagagauuauccagauuacaaauacagaccaagaagaaaagcaaaaaguucuggagcaggaccuagcagauguggacaaggaagaggaaaccuagcaucaggaggaccccuauggggaccaggauacgcaacaacacaaccaucaagaggauuuggauauagaccaccaucuuacucaacagcauacuuaccaggaagcuauggaucaucccauugcaaacuagaagcaccaagcccauguucacuaccacaaucagacccaagacuacaaggagaauuacuaccaacauauacacauuaccuaccaccuggaucaccaacaccauauaauccaccauuagcaggagcaccaaugccacuaacacacuuauaa

SEQ ID NO: 10027 - protein, 391 aa, Artificial Sequence
  Sox1__Homo_sapiens__O00570
MYSMMMETDLHSPGGAQAPTNLSGPAGAGGGGGGGGGGGGGGGAKANQDRVKRPMNAFMVWSRGQRRKMAQENPKMHNSEISKRLGAEWKVMSEAEKRPFIDEAKRLRALHMKEHPDYKYRPRRKTKTLLKKDKYSLAGGLLAAGAGGGGAAVAMGVGVGVGAAAVGQRLESPGGAAGGGYAHVNGWANGAYPGSVAAAAAAAAMMQEAQLAYGQHPGAGGAHPHAHPAHPHPHHPHAHPHNPQPMHRYDMGALQYSPISNSQGYMSASPSGYGGLPYGAAAAAAAAAGGAHQNSAVAAAAAAAAASSGALGALGSLVKSEPSGSPPAPAHSRAPCPGDLREMISMYLPAGEGGDPAAAAAAAAQSRLHSLPQHYQGAGAGVNGTVPLTHI

SEQ ID NO: 10028 - RNA, 1176 nt, Artificial Sequence
  Sox1__Homo_sapiens__EAX09158
auguacagcaugaugauggagaccgaccugcacucgcccggcggcgcccaggcccccacgaaccucucgggccccgccggggcgggcggcggcgggggcggaggcgggggcggcggcggcggcgggggcgccaaggccaaccaggaccgggucaaacggcccaugaacgccuucaugguguggucccgcgggcagcggcgcaagauggcccaggagaaccccaagaugcacaacucggagaucagcaagcgccugggggccgaguggaaggucauguccgaggccgagaagcggccguucaucgacgaggccaagcggcugcgcgcgcugcacaugaaggagcacccggauuacaaguaccggccgcgccgcaagaccaagacgcugcucaagaaggacaaguacucgcuggccggcgggcuccuggcggccggcgcggguggcggcggcgcggcuguggccaugggcgugggcgugggcgugggcgcggcggccgugggccagcgccuggagagcccaggcggcgcggcgggcggcggcuacgcgcacgucaacggcugggccaacggcgccuaccccggcucgguggcggcggcggcggcggccgcggccaugaugcaggaggcgcagcuggccuacgggcagcacccgggcgcgggcggcgcgcacccgcacgcgcaccccgcgcacccgcacccgcaccacccgcacgcgcacccgcacaacccgcagcccaugcaccgcuacgacaugggcgcgcugcaguacagccccaucuccaacucgcagggcuacaugagcgcgucgcccucgggcuacggcggccuccccuacggcgccgcggccgccgccgccgccgcugcgggcggcgcgcaccagaacucggccguggcggcggcggcggcggcggcggccgcgucgucgggcgcccugggcgcgcugggcucucuggugaagucggagcccagcggcagcccgcccgccccagcgcacucgcgggcgccgugccccggggaccugcgcgagaugaucagcauguacuugcccgccggcgaggggggcgacccggcggcggcagcagcggccgcggcgcagagccggcugcacucgcugccgcagcacuaccagggcgcgggcgcgggcgugaacggcacggugccccugacgcacaucuag

SEQ ID NO: 10029 - RNA, 1176 nt, Artificial Sequence
  derived and/or modified sequence opt1 from Sox1__Homo_sapiens__EAX09158
auguacagcaugaugauggagaccgaccugcacucccccggcggggcccaggccccgaccaaccucagcggccccgcgggggccggcgggggcggcgggggcgggggcgggggcggcgggggcgggggcgccaaggccaaccaggaccgcgugaagcggcccaugaacgccuucauggucuggucccgcggccagcggcgcaagauggcgcaggagaaccccaagaugcacaacagcgagaucuccaagcggcugggggccgaguggaaggugaugagcgaggccgagaagcgcccguucaucgacgaggccaagcggcugcgcgcgcuccacaugaaggagcaccccgacuacaaguaccggccccgccggaagacgaagacccugcugaagaaggacaaguacucccucgccggcgggcugcuggccgccggcgccgggggcggcggggcggccguggccaugggcgucggggugggcgugggggccgccgcggucggccagcgccucgagagccccggcggggccgccggcgggggcuacgcccacgugaacgggugggccaacggcgcguacccgggcuccguggccgccgccgccgcggccgccgccaugaugcaggaggcgcagcuggccuacgggcagcaccccggcgccgggggcgcccacccccacgcccaccccgcgcacccgcacccccaccacccccacgcccacccccacaacccgcagcccaugcaccgguacgacaugggcgcccugcaguacagccccaucuccaacagccagggguacauguccgccagccccuccggcuacgggggccucccguacggggccgcggccgccgccgccgcggccgccggcggcgcccaccagaacagcgcggucgccgccgccgccgcggccgccgccgccuccagcggggcgcugggcgcccuggggucccucgucaagagcgagcccagcggcuccccgcccgcccccgcccacagccgcgcccccugccccggggaccugcgggagaugaucuccauguaccugcccgcgggcgagggcggggacccggccgccgccgcggccgccgccgcccagagccgccuccacucccugccccagcacuaccagggcgcgggggccggcgugaacgggaccgugccccugacccacaucuga

SEQ ID NO: 10030 - RNA, 1176 nt, Artificial Sequence
  derived and/or modified sequence opt2 from Sox1__Homo_sapiens__EAX09158
auguacuccaugaugauggagaccgaccuccacucccccggcggcgcccaggcccccaccaaccucuccggccccgccggcgccggcggcggcggcggcggcggcggcggcggcggcggcggcggcggcgccaaggccaaccaggaccgcgucaagcgccccaugaacgccuucauggucuggucccgcggccagcgccgcaagauggcccaggagaaccccaagaugcacaacuccgagaucuccaagcgccucggcgccgaguggaaggucauguccgaggccgagaagcgccccuucaucgacgaggccaagcgccuccgcgcccuccacaugaaggagcaccccgacuacaaguaccgcccccgccgcaagaccaagacccuccucaagaaggacaaguacucccucgccggcggccuccucgccgccggcgccggcggcggcggcgccgccgucgccaugggcgucggcgucggcgucggcgccgccgccgucggccagcgccucgagucccccggcggcgccgccggcggcggcuacgcccacgucaacggcugggccaacggcgccuaccccggcuccgucgccgccgccgccgccgccgccgccaugaugcaggaggcccagcucgccuacggccagcaccccggcgccggcggcgcccacccccacgcccaccccgcccacccccacccccaccacccccacgcccacccccacaacccccagcccaugcaccgcuacgacaugggcgcccuccaguacucccccaucuccaacucccagggcuacauguccgccucccccuccggcuacggcggccuccccuacggcgccgccgccgccgccgccgccgccgccggcggcgcccaccagaacuccgccgucgccgccgccgccgccgccgccgccgccuccuccggcgcccucggcgcccucggcucccucgucaaguccgagcccuccggcuccccccccgcccccgcccacucccgcgcccccugccccggcgaccuccgcgagaugaucuccauguaccuccccgccggcgagggcggcgaccccgccgccgccgccgccgccgccgcccagucccgccuccacucccucccccagcacuaccagggcgccggcgccggcgucaacggcaccgucccccucacccacaucuga

SEQ ID NO: 10031 - RNA, 1176 nt, Artificial Sequence
  derived and/or modified sequence opt3 from Sox1__Homo_sapiens__EAX09158
auguacagcaugaugauggagaccgaccugcacucccccggcggggcccaggcuccuacaaaccucucuggaccagccggugcaggcgggggaggcggugggggaggcggcgggggagguggcgggggagcgaaggcuaaucaagauagagugaaaaggccgaugaacgccuucauggucuggucacggggccagcgccgaaagauggcacaggaaaaucccaaaaugcauaacagugagaucagcaagcgucuuggugccgaauggaaaguuauguccgaggcugaaaagagaccuuuuauugacgaggcaaagaggcugcgggccuugcacaugaaagagcauccagauuauaaguaccgccccagaaggaaaacuaagacguuacugaaaaaggacaaguauucucuagcugggggacuccuggccgcgggcgcaggcgggggaggugccgcuguggccaugggcguaggggugggagucggcgcagcugccgugggucagcggcuugaaucgccugggggcgcggccggaggcggguacgcacacguuaauggaugggcuaacggugccuauccaggcucaguggcugccgcagccgcugcggcagccaugaugcaagaggcucagcuggccuacgggcagcaucccggagcaggcggugcccacccucacgcucauccagcccacccgcauccccaccacccucaugcacacccacauaauccccagccuaugcaccgcuaugauaugggggcguugcaauacagcccaauaaguaacucccagggcuacaugucugcuagccccuccggauauggcgggcucccguacggagccgcagccgcugccgcagcugccgcggguggcgcccaucagaauagcgcugucgcagccgcugccgcagcggccgcugccaguagcggggcacugggagcucugggcucucucgugaaauccgaaccuucagguucacccccagccccugcacacagucgagcccccugcccaggggacuuaagagagaugaucucuauguaucugcccgcuggcgagggaggcgauccugcggccgcagcugccgccgcugcacaguccaggcuucacagcuugccacaacauuaccagggggccggagcgggcguaaacgguaccguuccgcugacacacauuuga

SEQ ID NO: 10032 - RNA, 1176 nt, Artificial Sequence
  derived and/or modified sequence opt4 from Sox1__Homo_sapiens__EAX09158
auguacagcaugaugauggagaccgaccugcacagccccggcggcgcccaggcccccaccaaccugagcggccccgccggcgccggcggcggcggcggcggcggcggcggcggcggcggcggcggcggcgccaaggccaaccaggacagagugaagagacccaugaacgccuucaugguguggagcagaggccagagaagaaagauggcccaggagaaccccaagaugcacaacagcgagaucagcaagagacugggcgccgaguggaaggugaugagcgaggccgagaagagacccuucaucgacgaggccaagagacugagagcccugcacaugaaggagcaccccgacuacaaguacagacccagaagaaagaccaagacccugcugaagaaggacaaguacagccuggccggcggccugcuggccgccggcgccggcggcggcggcgccgccguggccaugggcgugggcgugggcgugggcgccgccgccgugggccagagacuggagagccccggcggcgccgccggcggcggcuacgcccacgugaacggcugggccaacggcgccuaccccggcagcguggccgccgccgccgccgccgccgccaugaugcaggaggcccagcuggccuacggccagcaccccggcgccggcggcgcccacccccacgcccaccccgcccacccccacccccaccacccccacgcccacccccacaacccccagcccaugcacagauacgacaugggcgcccugcaguacagccccaucagcaacagccagggcuacaugagcgccagccccagcggcuacggcggccugcccuacggcgccgccgccgccgccgccgccgccgccggcggcgcccaccagaacagcgccguggccgccgccgccgccgccgccgccgccagcagcggcgcccugggcgcccugggcagccuggugaagagcgagcccagcggcagcccccccgcccccgcccacagcagagcccccugccccggcgaccugagagagaugaucagcauguaccugcccgccggcgagggcggcgaccccgccgccgccgccgccgccgccgcccagagcagacugcacagccugccccagcacuaccagggcgccggcgccggcgugaacggcaccgugccccugacccacaucuga

SEQ ID NO: 10033 - RNA, 1176 nt, Artificial Sequence
  derived and/or modified sequence opt5 from Sox1__Homo_sapiens__EAX09158
auguacagcaugaugauggagaccgaccugcacucccccggcggggcccaggcuccuacaaaccucucuggaccggccggcgcugggggaggcgggggaggcggcgggggaggcgggggaggcgggggagcgaaggccaaucaagauagagugaaacggcccaugaacgccuucauggucuggagccgcggccagagacggaagauggcucaggaaaauccuaaaaugcauaacuccgagaucucuaagcgccugggcgccgaauggaaaguuaugagcgaggcugaaaagagacccuuuauugacgaggccaagcggcuucgcgcgcugcacaugaaagagcauccugauuauaaguacagaccccggcgcaaaacgaagacccuccugaaaaaggacaaguauucccuugccgggggacugcucgcugccggcgcugggggaggcggggccgcgguggccaugggagugggcgucggcgugggggcugccgcuguuggacagagacuggaaucuccuggcggggccgccggaggcggguacgcucacgugaauggcugggcgaacggagccuauccgggcagcgucgcugccgccgcugccgcggcugccaugaugcaagaggcccagcuggcuuacgggcagcaucccggagccggcggggcucacccucacgcccaucccgcgcacccucauccccaccacccgcaugcccacccucauaauccccagccuaugcaccgguaugauaugggagcucuccaauacucccccaucagcaacucucagggcuacauguccgccagccccucuggguauggcggacugccuuacggcgcugccgcggccgcugccgcugccgccgggggagcucaucaaaauuccgcgguggccgcugccgccgcugccgcggcugccagcucuggcgcccuuggggcucugggaucccucguuaaaagcgaaccguccggcucucccccugcccccgcgcacagccgcgcuccuugccccggggaccugagagagaugauuuccauguaucuuccggccggcgagggaggcgauccugccgcugccgcugccgcggccgcucagagccggcugcacucucucccccagcauuaccagggggccggagcuggcgugaacgggacagucccucugacccacaucuga

SEQ ID NO: 10034 - RNA, 1176 nt, Artificial Sequence
  derived and/or modified sequence opt6 from Sox1__Homo_sapiens__EAX09158
auguauaguaugaugauggaaacugauuuacauaguccaggaggagcucaagcaccgacaaaucugagugggccugcaggagcuggaggaggagggggagguggaggaggaggaggaggaggaggaggugcaaaagcaaaccaggacagaguaaaaagaccgaugaacgcauucaugguauggagucgaggacaaagaagaaaaauggcacaagaaaacccaaaaaugcacaauagcgaaauaucaaaaagauuaggggcagaauggaaaguaauguccgaagcagaaaaaagaccauuuauagaugaagcgaaaagauuaagggcacuucauaugaaagaacacccagauuauaaauauagaccaaggagaaaaacuaaaacauuauuaaaaaaagauaaauauaguuuagcgggaggacuauuagcagcaggagcuggaggaggaggugcagcaguagcaauggggguaggaguaggaguaggagccgcagcaguuggucaaagauuggaaaguccagggggagcugcaggaggaggauacgcucacguaaaugguugggcaaauggagcauauccaggaaguguagcagcagcagcagcagcagcagcaaugaugcaagaagcacaacuagcuuauggacaacauccaggagcagggggagcucauccacacgcacauccagcacauccucacccacaccauccacaugcacauccucauaauccacagccaaugcauagauacgauaugggugcauuacaauacagcccaauaaguaauucacaaggauauaugucagcaucaccuucaggauauggaggacuaccauauggagcagcggcagcagcagccgcagcagcaggaggagcacaucaaaauagugcaguugcggcagcggcagcggcagcagcagcaucuucaggagcuuuaggagcauuaggaucauuaguuaaaucagaaccaagcggaaguccaccagcaccugcacauaguagagcaccauguccuggagauuuaagagagaugauaaguauguauuuaccugcaggagaaggaggagauccagcagcagcagcagcagcagcagcacaaaguagauuacauucgcuaccacaacauuaucaaggagcaggugcaggaguaaauggaacuguaccauuaacacauauuuaa

SEQ ID NO: 10035 - protein, 317 aa, Artificial Sequence
  Sox2__Homo_sapiens__P48431
MYNMMETELKPPGPQQTSGGGGGNSTAAAAGGNQKNSPDRVKRPMNAFMVWSRGQRRKMAQENPKMHNSEISKRLGAEWKLLSETEKRPFIDEAKRLRALHMKEHPDYKYRPRRKTKTLMKKDKYTLPGGLLAPGGNSMASGVGVGAGLGAGVNQRMDSYAHMNGWSNGSYSMMQDQLGYPQHPGLNAHGAAQMQPMHRYDVSALQYNSMTSSQTYMNGSPTYSMSYSQQGTPGMALGSMGSVVKSEASSSPPVVTSSSHSRAPCQAGDLRDMISMYLPGAEVPEPAAPSRLHMSQHYQSGPVPGTAINGTLPLSHM

SEQ ID NO: 10036 - RNA, 954 nt, Artificial Sequence
  Sox2__Homo_sapiens__AAH13923
auguacaacaugauggagacggagcugaagccgccgggcccgcagcaaacuucggggggcggcggcggcaacuccaccgcggcggcggccggcggcaaccagaaaaacagcccggaccgcgucaagcggcccaugaaugccuucaugguguggucccgcgggcagcggcgcaagauggcccaggagaaccccaagaugcacaacucggagaucagcaagcgccugggcgccgaguggaaacuuuugucggagacggagaagcggccguucaucgacgaggcuaagcggcugcgagcgcugcacaugaaggagcacccggauuauaaauaccggccccggcggaaaaccaagacgcucaugaagaaggauaaguacacgcugcccggcgggcugcuggcccccggcggcaauagcauggcgagcggggucggggugggcgccggccugggcgcgggcgugaaccagcgcauggacaguuacgcgcacaugaacggcuggagcaacggcagcuacagcaugaugcaggaccagcugggcuacccgcagcacccgggccucaaugcgcacggcgcagcgcagaugcagcccaugcaccgcuacgacgugagcgcccugcaguacaacuccaugaccagcucgcagaccuacaugaacggcucgcccaccuacagcauguccuacucgcagcagggcaccccuggcauggcucuuggcuccauggguucgguggucaaguccgaggccagcuccagccccccugugguuaccucuuccucccacuccagggcgcccugccaggccggggaccuccgggacaugaucagcauguaucuccccggcgccgaggugccggaacccgccgcccccagcagacuucacaugucccagcacuaccagagcggcccggugcccggcacggccauuaacggcacacugccccucucacacauguga

SEQ ID NO: 10037 - RNA, 954 nt, Artificial Sequence
  derived and/or modified sequence opt1 from Sox2__Homo_sapiens__AAH13923
auguacaacaugauggagaccgagcugaagcccccgggcccccagcagaccagcgggggcgggggcgggaacuccacggccgccgcggccggcggcaaccagaagaacagccccgaccgcgugaagcggcccaugaacgccuucauggucuggucccgcgggcagcggcgcaagauggcccaggagaacccgaagaugcacaacagcgagaucuccaagcggcucggcgccgaguggaagcugcugagcgagaccgagaagcgccccuucaucgacgaggcgaagcggcuccgcgcccugcacaugaaggagcaccccgacuacaaguaccggccccgccggaagaccaagacccugaugaagaaggacaaguacacgcuccccgggggccugcuggcccccgggggcaacuccauggccagcggcgugggggugggcgcggggcucggcgccggcgucaaccagcgcauggacuccuacgcccacaugaacggguggagcaacggcuccuacagcaugaugcaggaccagcugggguacccccagcaccccggccugaacgcccacggggccgcgcagaugcagccgaugcaccgguacgacguguccgcccuccaguacaacagcaugaccuccagccagaccuacaugaacggcucccccaccuacagcauguccuacagccagcagggcacgcccgggauggcccugggcagcaugggguccguggucaagagcgaggccuccagcuccccgccgguggugaccagcuccagccacucccgcgcccccugccaggcgggcgaccugcgggacaugaucagcauguaccuccccggggccgagguccccgagccggccgcccccucccgccugcacaugagccagcacuaccaguccggccccgugcccggcaccgccaucaacgggacccugccgcucagccacauguga

SEQ ID NO: 10038 - RNA, 954 nt, Artificial Sequence
  derived and/or modified sequence opt2 from Sox2__Homo_sapiens__AAH13923
auguacaacaugauggagaccgagcucaagccccccggcccccagcagaccuccggcggcggcggcggcaacuccaccgccgccgccgccggcggcaaccagaagaacucccccgaccgcgucaagcgccccaugaacgccuucauggucuggucccgcggccagcgccgcaagauggcccaggagaaccccaagaugcacaacuccgagaucuccaagcgccucggcgccgaguggaagcuccucuccgagaccgagaagcgccccuucaucgacgaggccaagcgccuccgcgcccuccacaugaaggagcaccccgacuacaaguaccgcccccgccgcaagaccaagacccucaugaagaaggacaaguacacccuccccggcggccuccucgcccccggcggcaacuccauggccuccggcgucggcgucggcgccggccucggcgccggcgucaaccagcgcauggacuccuacgcccacaugaacggcugguccaacggcuccuacuccaugaugcaggaccagcucggcuacccccagcaccccggccucaacgcccacggcgccgcccagaugcagcccaugcaccgcuacgacgucuccgcccuccaguacaacuccaugaccuccucccagaccuacaugaacggcucccccaccuacuccauguccuacucccagcagggcacccccggcauggcccucggcuccaugggcuccgucgucaaguccgaggccuccuccuccccccccgucgucaccuccuccucccacucccgcgcccccugccaggccggcgaccuccgcgacaugaucuccauguaccuccccggcgccgagguccccgagcccgccgcccccucccgccuccacaugucccagcacuaccaguccggccccguccccggcaccgccaucaacggcacccucccccucucccacauguga

SEQ ID NO: 10039 - RNA, 954 nt, Artificial Sequence
  derived and/or modified sequence opt3 from Sox2__Homo_sapiens__AAH13923
auguacaacaugauggagaccgaacugaagcccccuggcccacagcaaacaagcgggggagguggcggaaauuccacugccgcugcagccgggggcaaccagaaaaauucuccggacagagugaagaggcccaugaacgcguucauggucuggucacggggucagcgccgaaaaauggcucaggagaauccuaagaugcacaacagugaaaucagcaaacgucucggggccgaguggaaacuucuguccgaaacggagaagagaccauuuauugaugaggcaaagagguugcgggccuuacauaugaaggaacaccccgacuauaaauaccgcccuagaaggaagaccaaaacacugaugaagaaggauaaauauacucuaccaggaggccuccuggcucccggcggaaauucuauggcaucggggguuggugugggcgccgggcuuggagcuggcguaaaccaacggauggacucauacgcccauaugaaugguuggagcaacgggaguuauuccaugaugcaggaucagcugggauacccucagcacccaggcuugaaugcgcauggcgcagcccaaaugcagccgaugcaccgcuaugacgugucugcucuccaguacaacagcaugaccuccucacagacauacaugaaugggagucccaccuauagcaugucuuacucccaacagggaacuccugguauggcccugggcucaauggggagcgucgugaagagugaggcaucuuccagcccacccguugugacaucgucuucccacucacgagcuccuugccaggccggagaucugagagacaugauaaguauguaucucccaggcgcggaaguccccgagccggccgcaccuagcagguuacauaugucccaacacuaccagucuggucccgugccagggaccgcuaucaacggcacgcugccucuuagccauauguga

SEQ ID NO: 10040 - RNA, 954 nt, Artificial Sequence
  derived and/or modified sequence opt4 from Sox2__Homo_sapiens__AAH13923
auguacaacaugauggagaccgagcugaagccccccggcccccagcagaccagcggcggcggcggcggcaacagcaccgccgccgccgccggcggcaaccagaagaacagccccgacagagugaagagacccaugaacgccuucaugguguggagcagaggccagagaagaaagauggcccaggagaaccccaagaugcacaacagcgagaucagcaagagacugggcgccgaguggaagcugcugagcgagaccgagaagagacccuucaucgacgaggccaagagacugagagcccugcacaugaaggagcaccccgacuacaaguacagacccagaagaaagaccaagacccugaugaagaaggacaaguacacccugcccggcggccugcuggcccccggcggcaacagcauggccagcggcgugggcgugggcgccggccugggcgccggcgugaaccagagaauggacagcuacgcccacaugaacggcuggagcaacggcagcuacagcaugaugcaggaccagcugggcuacccccagcaccccggccugaacgcccacggcgccgcccagaugcagcccaugcacagauacgacgugagcgcccugcaguacaacagcaugaccagcagccagaccuacaugaacggcagccccaccuacagcaugagcuacagccagcagggcacccccggcauggcccugggcagcaugggcagcguggugaagagcgaggccagcagcagcccccccguggugaccagcagcagccacagcagagcccccugccaggccggcgaccugagagacaugaucagcauguaccugcccggcgccgaggugcccgagcccgccgcccccagcagacugcacaugagccagcacuaccagagcggccccgugcccggcaccgccaucaacggcacccugccccugagccacauguga

SEQ ID NO: 10041 - RNA, 954 nt, Artificial Sequence
  derived and/or modified sequence opt5 from Sox2__Homo_sapiens__AAH13923
auguacaacaugauggagaccgaacugaagcccccuggcccgcagcaaacaagcgggggaggcgggggaaauuccacggccgcugccgcgggcgggaaccagaaaaauucucccgacagagugaagcggccuaugaacgcuuucauggucuggagccgcggacagagacggaaaauggcccaggagaaucccaagaugcacaacuccgaaaucucuaaacgccucggcgccgaguggaagcugcuuagcgaaaccgagaagagaccuuuuauugaugaggcuaaacggcugcgcgcccuccauaugaaggaacaccccgacuauaaauacagaccucggcgcaagacaaaaacccugaugaagaaggauaaauauacacuuccgggcgggcugcucgcucccggaggcaauuccauggccucugggguuggagugggcgcggggcugggagccggcgugaaccaaagaauggacagcuacgcucauaugaauggcugguccaacgggagcuauucuaugaugcaggaucagcugggauacccucagcaccccggccucaaugcccauggggcugcccaaaugcagccuaugcaccgguaugacgucuccgcgcugcaguacaacagcaugaccucuucccagacauacaugaauggaagccccaccuauucuauguccuacagccaacagggcacgccggggauggcccuuggauccaugggcucugugguuaagagcgaggcuuccagcucuccucccguggucaccuccagcucucacagccgcgccccuugccaggcuggcgaucugagagacaugaucuccauguaucuccccggggccgaagugcccgagccugccgcuccgucucggcugcauaugagccaacacuaccaguccggacccguuccuggcacagcgauuaacgggacccuuccccugagccauauguga

SEQ ID NO: 10042 - RNA, 954 nt, Artificial Sequence
  derived and/or modified sequence opt6 from Sox2__Homo_sapiens__AAH13923
auguacaacaugauggaaacagaauuaaaaccaccaggaccacaacaaacaucaggcggaggaggaggaaauucaacagcagcagcggcaggaggaaaucaaaaaaacagcccagauagaguaaaaagaccaaugaaugcauucaugguauggagccgaggacaaagaagaaaaauggcacaagaaaacccaaaaaugcacaacucagaaauaagcaaaagacuaggagcagaauggaaauuacuaucagaaacagaaaaacgaccauucauagacgaagcaaaaagacuacgagcauuacacaugaaagaacaucccgacuauaaauauagaccaagaagaaagacaaaaacacuaaugaaaaaagauaaauauacauuaccaggaggacuauuagccccaggaggaaacucaauggcaucaggaguuggaguuggagcaggacuaggagcaggaguaaaucaaagaauggauucauacgcacacaugaacggauggucaaacggaucauauucaaugaugcaagaccaauuaggauacccacaacauccaggauuaaacgcacauggagcagcacaaaugcaacccaugcacagauacgauguaucagcacuucaauauaacucaaugacaagcucacaaacauacaugaacggaucaccaacauauucuaugagcuauagccaacaagguacaccuggaauggcacugggaaguaugggaucaguaguaaaaagcgaagcaucaucaucaccaccaguaguaacaucaucaucccacaguagagcaccaugucaagcaggagauuuaagagacaugauaucaauguaucuaccaggagcagaaguaccagaaccagcagcaccaagcagauuacauaugucacaacauuaccaaaguggaccaguaccaggaacagcaauaaauggaacacuaccauuaucacacauguaa

SEQ ID NO: 10043 - protein, 446 aa, Artificial Sequence
  Sox3__Homo_sapiens__P41225
MRPVRENSSGARSPRVPADLARSILISLPFPPDSLAHRPPSSAPTESQGLFTVAAPAPGAPSPPATLAHLLPAPAMYSLLETELKNPVGTPTQAAGTGGPAAPGGAGKSSANAAGGANSGGGSSGGASGGGGGTDQDRVKRPMNAFMVWSRGQRRKMALENPKMHNSEISKRLGADWKLLTDAEKRPFIDEAKRLRAVHMKEYPDYKYRPRRKTKTLLKKDKYSLPSGLLPPGAAAAAAAAAAAAAAASSPVGVGQRLDTYTHVNGWANGAYSLVQEQLGYAQPPSMSSPPPPPALPPMHRYDMAGLQYSPMMPPGAQSYMNVAAAAAAASGYGGMAPSATAAAAAAYGQQPATAAAAAAAAAAMSLGPMGSVVKSEPSSPPPAIASHSQRACLGDLRDMISMYLPPGGDAADAASPLPGGRLHGVHQHYQGAGTAVNGTVPLTHI

SEQ ID NO: 10044 - RNA, 1341 nt, Artificial Sequence
  Sox3__Homo_sapiens__AAF73059
augcgaccuguucgagagaacucaucaggugcgagaagcccgcggguuccugcugauuuggcgcggagcauuuugauaagccuacccuucccgccggacucgcuggcccacaggcccccaagcuccgcuccgacggagucccagggccuuuucaccguggccgcuccagccccgggagcgccuucuccucccgccacgcuggcgcaccuucuucccgccccggcaauguacagccuucuggagacugaacucaagaaccccguagggacacccacacaagcggcgggcaccggcggccccgcagccccgggaggcgcaggcaagaguagugcgaacgcagccggcggcgcgaacucgggcggcggcagcagcgguggugcgagcggagguggcggggguacagaccaggaccgugugaaacggcccaugaacgccuucaugguauggucccgcgggcagcggcgcaaaauggcccuggagaaccccaagaugcacaauucugagaucagcaagcgcuugggcgccgacuggaaacugcugaccgacgccgagaagcgaccauucaucgacgaggccaagcgacuucgcgccgugcacaugaaggaguauccggacuacaaguaccgaccgcgccgcaagaccaagacgcugcucaagaaagauaaguacucccugcccagcggccuccugccucccggugccgcggccgccgccgccgcugccgcggccgcagccgcugccgccagcaguccggugggcgugggccagcgccuggacacguacacgcacgugaacggcugggccaacggcgcguacucgcuggugcaggagcagcugggcuacgcgcagcccccgagcaugagcagcccgccgccgccgcccgcgcugccgccgaugcaccgcuacgacauggccggccugcaguacagcccaaugaugccgcccggcgcucagagcuacaugaacgucgcugccgcggccgccgccgccucgggcuacgggggcauggcgcccucagccacagcagccgcggccgccgccuacgggcagcagcccgccaccgccgcggccgcagcugcggccgcagccgccaugagccugggccccaugggcucgguagugaagucugagcccagcucgccgccgcccgccaucgcaucgcacucucagcgcgcgugccucggcgaccugcgcgacaugaucagcauguaccugccacccggcggggacgcggccgacgccgccucuccgcugcccggcggucgccugcacggcgugcaccagcacuaccagggcgccgggacugcagucaacggaacggugccgcugacccacaucuga

SEQ ID NO: 10045 - RNA, 1341 nt, Artificial Sequence
  derived and/or modified sequence opt1 from Sox3__Homo_sapiens__AAF73059
augcgccccgugcgggagaacagcuccggcgcccgcagcccgcggguccccgccgaccuggcgcgcuccauccucaucagccugcccuuccccccggacucccuggcccaccggccccccagcuccgcccccaccgagagccaggggcucuucaccguggccgccccggcgcccggcgcccccucccccccggccacgcuggcccaccugcuccccgcgcccgccauguacagccugcuggagaccgagcucaagaaccccguggggaccccgacccaggccgccggcacggggggccccgccgcgcccggcggggccggcaaguccagcgccaacgccgccgggggcgcgaacuccgggggcggcagcuccgggggcgccagcgggggcggcgggggcaccgaccaggaccgcgucaagcggcccaugaacgccuucaugguguggucccgcgggcagcggcgcaagauggcccuggagaacccgaagaugcacaacagcgagaucuccaagcggcugggcgccgacuggaagcuccugaccgacgcggagaagcgccccuucaucgacgaggccaagcggcugcgcgccgugcacaugaaggaguaccccgacuacaaguaccggccccgccggaagaccaagacgcuccugaagaaggacaaguacagccugccgagcgggcuccugccccccggcgccgccgcggccgccgccgcggccgccgccgccgcggccgccgccuccagccccgucggcguggggcagcgccuggacaccuacacccacgugaacggcugggccaacggggcguacucccucguccaggagcagcugggcuacgcccagccgcccagcauguccagccccccgcccccccccgcccugccgcccaugcaccgguacgacauggccgggcuccaguacucccccaugaugcccccgggcgcccagagcuacaugaacguggcggccgccgccgcggccgccuccggcuacgggggcauggcccccagcgccaccgcggccgccgccgccgcguacgggcagcagcccgccacggccgccgccgcggccgccgccgcggccgccaugucccugggccccauggggagcguggucaaguccgagccgagcucccccccccccgccaucgccagccacucccagcgcgcgugccugggcgaccuccgggacaugaucagcauguaccugccgcccggcggggacgccgccgacgccgccuccccccugcccggcgggcgccuccacggcgugcaccagcacuaccagggcgcggggaccgccgugaacggcaccgucccgcugacccacaucuga

SEQ ID NO: 10046 - RNA, 1341 nt, Artificial Sequence
  derived and/or modified sequence opt2 from Sox3__Homo_sapiens__AAF73059
augcgccccguccgcgagaacuccuccggcgcccgcuccccccgcguccccgccgaccucgcccgcuccauccucaucucccuccccuucccccccgacucccucgcccaccgcccccccuccuccgcccccaccgagucccagggccucuucaccgucgccgcccccgcccccggcgcccccuccccccccgccacccucgcccaccuccuccccgcccccgccauguacucccuccucgagaccgagcucaagaaccccgucggcacccccacccaggccgccggcaccggcggccccgccgcccccggcggcgccggcaaguccuccgccaacgccgccggcggcgccaacuccggcggcggcuccuccggcggcgccuccggcggcggcggcggcaccgaccaggaccgcgucaagcgccccaugaacgccuucauggucuggucccgcggccagcgccgcaagauggcccucgagaaccccaagaugcacaacuccgagaucuccaagcgccucggcgccgacuggaagcuccucaccgacgccgagaagcgccccuucaucgacgaggccaagcgccuccgcgccguccacaugaaggaguaccccgacuacaaguaccgcccccgccgcaagaccaagacccuccucaagaaggacaaguacucccuccccuccggccuccucccccccggcgccgccgccgccgccgccgccgccgccgccgccgccgccgccgccuccucccccgucggcgucggccagcgccucgacaccuacacccacgucaacggcugggccaacggcgccuacucccucguccaggagcagcucggcuacgcccagccccccuccauguccucccccccccccccccccgcccucccccccaugcaccgcuacgacauggccggccuccaguacucccccaugaugccccccggcgcccaguccuacaugaacgucgccgccgccgccgccgccgccuccggcuacggcggcauggcccccuccgccaccgccgccgccgccgccgccuacggccagcagcccgccaccgccgccgccgccgccgccgccgccgccgccaugucccucggccccaugggcuccgucgucaaguccgagcccuccucccccccccccgccaucgccucccacucccagcgcgccugccucggcgaccuccgcgacaugaucuccauguaccucccccccggcggcgacgccgccgacgccgccuccccccuccccggcggccgccuccacggcguccaccagcacuaccagggcgccggcaccgccgucaacggcaccgucccccucacccacaucuga

SEQ ID NO: 10047 - RNA, 1341 nt, Artificial Sequence
  derived and/or modified sequence opt3 from Sox3__Homo_sapiens__AAF73059
augagacccgugagggagaacagcuccggcgcccggucuccucgcgucccagcugaccuggcacgaucaauccucauuagucuuccguuucccccugauagccuggcccaccguccacccuccucugcgccuaccgaaucgcagggguuguucacaguugcugccccagcacccggagccccuucaccaccggcuacuuuagcacaucugcuacccgccccugcuauguacagccuccuggagacggaacuuaagaauccaguggguacccccacacaagccgcgggcacugggggaccugcagccccaggcggugcugggaaaaguuccgccaacgcagcuggaggcgccaauucuggcgggggaagcuccgguggcgcgucagggggaggcggugggaccgaccaggauagaguaaagaggcccaugaacgccuucaugguguggagucggggacagcgcagaaaaauggcacuggagaauccgaagaugcacaacagcgaaauaucuaaaagguugggcgcugacuggaagcuccugacagaugccgagaagcggccuuuuaucgacgaggcuaaacgccugcgagccguccauaugaaggaauaucccgauuacaaauauagaccaaggcggaagaccaaaacucucuuaaagaaggacaaauacucccugccuucaggccuuuugcccccaggggcagccgcugcggcagccgcugccgcagccgcugccgcagcggcuagcagucccgugggaguuggucagcgucuggauacauauacccacgugaauggcugggccaacggggcauacucucuaguccaagagcagcucggauaugcccagccuccauccaugagcucgccgcccccuccacccgcucugccuccaaugcaucgcuacgacauggccggccuucaguacucucccaugaugccgccuggugcacaauccuauaugaauguggcugccgcggccgcugcagccucaggguacggcggaauggcuccaagugccacggcagcggccgcugccgcauauggccagcagcccgcuacugccgcagccgcugcggccgcagcugccgccaugagccuggggccuaugggauccguaguuaagucugaacccagcucaccaccucccgcuauugcaagucacucccagagagccugcuugggugaucucagggacaugaucagcauguaccugccaccgggcggggaugcggcugacgccgcaucuccuuuacccggaggccggcugcacggugugcaucaacacuaucagggggccggcaccgcugucaacggaacagugccacucacucauauuuga

SEQ ID NO: 10048 - RNA, 1341 nt, Artificial Sequence
  derived and/or modified sequence opt4 from Sox3__Homo_sapiens__AAF73059
augagacccgugagagagaacagcagcggcgccagaagccccagagugcccgccgaccuggccagaagcauccugaucagccugcccuucccccccgacagccuggcccacagaccccccagcagcgcccccaccgagagccagggccuguucaccguggccgcccccgcccccggcgcccccagcccccccgccacccuggcccaccugcugcccgcccccgccauguacagccugcuggagaccgagcugaagaaccccgugggcacccccacccaggccgccggcaccggcggccccgccgcccccggcggcgccggcaagagcagcgccaacgccgccggcggcgccaacagcggcggcggcagcagcggcggcgccagcggcggcggcggcggcaccgaccaggacagagugaagagacccaugaacgccuucaugguguggagcagaggccagagaagaaagauggcccuggagaaccccaagaugcacaacagcgagaucagcaagagacugggcgccgacuggaagcugcugaccgacgccgagaagagacccuucaucgacgaggccaagagacugagagccgugcacaugaaggaguaccccgacuacaaguacagacccagaagaaagaccaagacccugcugaagaaggacaaguacagccugcccagcggccugcugccccccggcgccgccgccgccgccgccgccgccgccgccgccgccgccgccgccagcagccccgugggcgugggccagagacuggacaccuacacccacgugaacggcugggccaacggcgccuacagccuggugcaggagcagcugggcuacgcccagccccccagcaugagcagccccccccccccccccgcccugccccccaugcacagauacgacauggccggccugcaguacagccccaugaugccccccggcgcccagagcuacaugaacguggccgccgccgccgccgccgccagcggcuacggcggcauggcccccagcgccaccgccgccgccgccgccgccuacggccagcagcccgccaccgccgccgccgccgccgccgccgccgccgccaugagccugggccccaugggcagcguggugaagagcgagcccagcagccccccccccgccaucgccagccacagccagagagccugccugggcgaccugagagacaugaucagcauguaccugccccccggcggcgacgccgccgacgccgccagcccccugcccggcggcagacugcacggcgugcaccagcacuaccagggcgccggcaccgccgugaacggcaccgugccccugacccacaucuga

SEQ ID NO: 10049 - RNA, 1341 nt, Artificial Sequence
  derived and/or modified sequence opt5 from Sox3__Homo_sapiens__AAF73059
augagacccgugcgggagaacuccuccggcgcccgcucuccuagagucccggcugaccuggcccggagcauccucauuucccugcccuucccucccgauucucuugcgcaccgcccucccagcuccgcuccuaccgaaucucaggggcuguuuacaguugccgccccggcucccggagccccuagcccucccgcuacgcucgcccaucugcuucccgcgccggccauguacucccugcucgagaccgaacugaagaauccugugggcacacccacccaagcugccgggacaggaggcccugcugcccccgggggagcgggcaaaagcucugccaacgcugccggcggggcuaauuccggaggcgggagcucuggaggcgccuccgggggaggcggcgggaccgaccaggauagagugaagcggcccaugaacgccuucauggucuggagccgcggacagagacggaaaauggcucuggagaauccuaagaugcacaacucugaaaucuccaaacgccucggcgcggacuggaagcugcuuacagaugccgagaagagaccguuuauugacgaggcuaaacggcugcgcgccgugcauaugaaggaauaucccgauuacaaauauagaccucggcgcaagaccaaaacgcuccugaagaaggacaaauacagccuucccuccgggcugcucccucccggagccgcugccgcggcugccgccgcugccgcugccgcggccgcugccucuagcccgguuggcguggggcagagacuggauaccuauacacacgucaauggaugggcuaacggcgccuacucccuggugcaagagcagcucggcuaugcgcagccucccagcaugucuuccccucccccucccccggcccugccucccaugcaucgguacgacauggcugggcuucaguacagccccaugaugccuccgggagcccaaucuuauaugaauguugcugccgccgcugcggccgcuagcggcuacgggggaauggcccccuccgccaccgcugccgcggcugccgccuauggccagcagccugcuacagccgcggcugccgccgcugccgcugccgcgaugucucuggggcccaugggcagcguggucaaguccgaaccuagcucucccccucccgccaucgcuucccacagccagagagccugccucggagaucugcgcgacaugauuucuauguaccuuccgccuggcggggaugcugccgacgccgcuagcccccugccuggaggccggcuccacggggugcaucaacacuaucagggagcgggcaccgccgugaacgggacggucccccugacacauaucuga

SEQ ID NO: 10050 - RNA, 1341 nt, Artificial Sequence
  derived and/or modified sequence opt6 from Sox3__Homo_sapiens__AAF73059
augagaccaguaagagaaaauaguucuggugcacguucaccuagaguaccagcagauuuagcuagaucaauacuuauuucauuaccauuuccaccagauagccuagcacaccgaccaccuucaucagcaccuacagaaucacaaggauuauuuacuguagcagcaccagcaccaggagcuccaucacccccagcuacacuagcacauuuacuaccagcaccagcaauguauagccuacuagaaacugaacuuaaaaaccccguaggaacacccacacaagcagcaggaacaggagguccagcagcaccaggaggagccggaaaaucaucagcuaacgcagcaggaggcgccaauucaggcggagguucuucaggaggugcauccggagguggaggaggcacagaccaagauagaguaaaaagaccaaugaaugcauucaugguauggaguagaggacaaagaagaaaaauggcacucgaaaacccaaaaaugcauaauagcgaaauaucaaaaagguuaggagcagacuggaaauuauugacagacgcagaaaaaagaccauuuauugaugaagcuaaaagacuaagagcuguucauaugaaagaauacccugauuauaaauauagaccaagaaggaaaacaaaaacauuauuaaaaaaagauaaauauucauuaccuaguggauuauuaccaccaggugcagcagcagcagcagcagccgcagcagcagcagcugcagcugcaucaucaccuguaggaguaggacaaagauuagauacauauacacauguaaauggaugggcaaauggcgcauauucauuaguacaagaacaauuaggauacgcucaaccaccaaguaugucaagcccaccuccuccaccagcauuaccaccaaugcauagauaugauauggcuggauuacaauauagcccaaugaugccacccggugcucaaucauauaugaauguagcagcagccgcagcagcagcuagcggauacggcggaauggcuccuagugcaacugcagcggcagcagcagcguacggacaacaaccagcaacagcagcagcugcagcagcagcugcugccgcaauguccuuaggaccgauggguucaguaguaaaaucagaaccaucaucuccaccaccagcaauagcaucacauucacaaagggcaugucuaggagauuuacgagauaugauaucaauguaucuaccaccaggaggagaugcagcagaugcggcaucuccauuaccuggaggaagacuacauggaguucaucaacauuaccaaggagcaggaacagcaguaaauggaacuguaccacuaacacacauauaa

SEQ ID NO: 10051 - DNA, 42 bp, Artificial Sequence
  5-UTR of human ribosomal protein Large 32 lacking the 5 terminal oligopyrimidine tract
ggcgctgcctacggaggtggcagccatctccttctcggcatc

SEQ ID NO: 10052 - RNA, 42 nt, Artificial Sequence
  5-UTR of human ribosomal protein Large 32 lacking the 5 terminal oligopyrimidine tract mRNA
ggcgcugccuacggagguggcagccaucuccuucucggcauc

SEQ ID NO: 10053 - DNA, 75 bp, Artificial Sequence
  5-UTR of human mitochondrial ATP synthase subunit alpha lacking the 5 terminal oligopyrimidine tract
gcggctcggccattttgtcccagtcagtccggaggctgcggctgcagaagtaccgcctgcggagtaactgcaaag

SEQ ID NO: 10054 - RNA, 75 nt, Artificial Sequence
  5-UTR of human mitochondrial ATP synthase subunit alpha lacking the 5 terminal oligopyrimidine tract mRNA
gcggcucggccauuuugucccagucaguccggaggcugcggcugcagaaguaccgccugcggaguaacugcaaag

SEQ ID NO: 10055 - DNA, 110 bp, Artificial Sequence
  3-UTR of Homo sapiens hemoglobin, alpha 1 (HBA1)
gctggagcctcggtggccatgcttcttgccccttgggcctccccccagcccctcctccccttcctgcacccgtacccccgtggtctttgaataaagtctgagtgggcggc

SEQ ID NO: 10056 - RNA, 110 nt, Artificial Sequence
  3-UTR of Homo sapiens hemoglobin, alpha 1 (HBA1) mRNA
gcuggagccucgguggccaugcuucuugccccuugggccuccccccagccccuccuccccuuccugcacccguacccccguggucuuugaauaaagucugagugggcggc

SEQ ID NO: 10057 - DNA, 108 bp, Artificial Sequence
  3-UTR of Homo sapiens hemoglobin, alpha 2 (HBA2)
gctggagcctcggtagccgttcctcctgcccgctgggcctcccaacgggccctcctcccctccttgcaccggcccttcctggtctttgaataaagtctgagtgggcag

SEQ ID NO: 10058 - RNA, 108 nt, Artificial Sequence
  3-UTR of Homo sapiens hemoglobin, alpha 2 (HBA2) mRNA
gcuggagccucgguagccguuccuccugcccgcugggccucccaacgggcccuccuccccuccuugcaccggcccuuccuggucuuugaauaaagucugagugggcag

SEQ ID NO: 10059 - DNA, 132 bp, Artificial Sequence
  3-UTR of Homo sapiens hemoglobin, beta (HBB)
gctcgctttcttgctgtccaatttctattaaaggttcctttgttccctaagtccaactactaaactgggggatattatgaagggccttgagcatctggattctgcctaataaaaaacatttattttcattgc

SEQ ID NO: 10060 - RNA, 132 nt, Artificial Sequence
  3-UTR of Homo sapiens hemoglobin, beta (HBB) mRNA
gcucgcuuucuugcuguccaauuucuauuaaagguuccuuuguucccuaaguccaacuacuaaacugggggauauuaugaagggccuugagcaucuggauucugccuaauaaaaaacauuuauuuucauugc

SEQ ID NO: 10061 - DNA, 44 bp, Artificial Sequence
  Center, alpha-complex-binding portion of the 3UTR of an alpha-globin gene (muag)
gcccgatgggcctcccaacgggccctcctcccctccttgcaccg

SEQ ID NO: 10062 - RNA, 44 nt, Artificial Sequence
  Center, alpha-complex-binding portion of the 3UTR of an alpha-globin gene (muag) mRNA
gcccgaugggccucccaacgggcccuccuccccuccuugcaccg

SEQ ID NO: 10063 - DNA, 186 bp, Artificial Sequence
  3-UTR of human albumin
catcacatttaaaagcatctcagcctaccatgagaataagagaaagaaaatgaagatcaaaagcttattcatctgtttttctttttcgttggtgtaaagccaacaccctgtctaaaaaacataaatttctttaatcattttgcctcttttctctgtgcttcaattaataaaaaatggaaagaatct

SEQ ID NO: 10064 - RNA, 186 nt, Artificial Sequence
  3-UTR of human albumin mRNA
caucacauuuaaaagcaucucagccuaccaugagaauaagagaaagaaaaugaagaucaaaagcuuauucaucuguuuuucuuuuucguugguguaaagccaacacccugucuaaaaaacauaaauuucuuuaaucauuuugccucuuuucucugugcuucaauuaauaaaaaauggaaagaaucu

SEQ ID NO: 10065 - DNA, 186 bp, Artificial Sequence
  3-UTR albumin7
catcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacct

SEQ ID NO: 10066 - RNA, 186 nt, Artificial Sequence
  3-UTR albumin7 mRNA
caucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccu

SEQ ID NO: 10067 - DNA, 187 bp, Artificial Sequence
  3-UTR ALB7
gcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccu

SEQ ID NO: 10068 - RNA, 187 nt, Artificial Sequence
  3-UTR ALB7 mRNA
gcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccu

SEQ ID NO: 10069 - DNA, 24 bp, Artificial Sequence
  histone stem-loop sequence
caaaggcucuuuucagagccacca

SEQ ID NO: 10070 - RNA, 24 nt, Artificial Sequence
  histone stem-loop sequence mRNA
caaaggcucuuuucagagccacca

SEQ ID NO: 10071 - RNA, 13 nt, Artificial Sequence
  Kozak
gccgccaccaugg

SEQ ID NO: 10072 - RNA, 547 nt, Artificial sequence
  Synthetic immunostimulatory RNA
gggagaaagcucaagcuuauccaaguaggcuggucaccuguacaacguagccgguauuuuuuuuuuuuuuuuuuuuuugaccgucucaagguccaaguuagucugccuauaaaggugcggauccacagcugaugaaagacuugugcgguacgguuaaucuccccuuuuuuuuuuuuuuuuuuuuuaguaaaugcgucuacugaauccagcgaugaugcuggcccagaucuucgaccacaagugcauauaguagucaucgagggucgccuuuuuuuuuuuuuuuuuuuuuuuggcccaguucugagacuucgcuagagacuacaguuacagcugcaguaguaaccacugcggcuauugcaggaaaucccguucagguuuuuuuuuuuuuuuuuuuuuccgcucacuaugauuaagaaccagguggagugucacugcucucgaggucucacgagagcgcucgauacagugcuuggaagaaucuuuuuuuuuuuuuuuuuuuuuugugcgacgaucacagagaacuucuauucaugcaggucugcucuag

SEQ ID NO: 10073 - RNA, 1165 nt, Artificial sequence
  Synthetic mRNA
ggggcgcugccuacggagguggcagccaucuccuucucggcaucaagcuuaccaugaucgagaccuacagccagcccuccccgcggagcguggccaccggccugcccgccuccaugaagaucuucauguaccuccugacggucuuccugaucacccagaugaucgggagcgugcucuucgcgguguaccugcaccgccggcuggacaaggucgaggaggaggugaaccuccacgaggacuucguguucaucaagaagcugaagcgcugcaacaagggcgaggggucccugagccuccugaacugcgaggagaugcggcgccaguucgaggaccuggucaaggacaucacccucaacaaggaggagaagaaggagaacuccuucgagaugcagcggggcgacgaggacccccagaucgccgcccacguggugagcgaggccaacuccaacgccgcgagcguccugcagugggccaagaagggguacuacaccaugaaguccaaccuggugaugcucgagaacggcaagcagcugacggugaagcgcgagggccuguacuacgucuacacccaggugaccuucugcagcaaccgggagcccuccagccagcgcccguucaucguggggcucuggcugaagcccuccagcggcuccgagcggauccugcucaaggccgccaacacccacagcuccagccagcugugcgagcagcagagcguccaccugggcggcguguucgagcuccaggcgggggccuccguguucgucaacgugacggaggccagccaggugauccaccgcgucggguucuccagcuucggccugcugaagcucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu
